(12) United States Patent
Hakonarson et al.

(10) Patent No.: US 8,575,120 B2
(45) Date of Patent: Nov. 5, 2013

(54) GENETIC ALTERATIONS ON CHROMOSOME 12 AND METHODS OF USE THEREOF FOR THE DIAGNOSIS AND TREATMENT OF TYPE 1 DIABETES

(75) Inventors: Hakon Hakonarson, Malvern, PA (US); Struan F. A. Grant, Philadelphia, PA (US); Jonathan P. Bradfield, Philadelphia, PA (US); Constantin Polychronakos, Quebec (CA)

(73) Assignee: The Children's Hospital of Philadelphia, Philadelphia, PA (US)

( * ) Notice: Subject to any disclaimer, the term of this patent is extended or adjusted under 35 U.S.C. 154(b) by 550 days.

(21) Appl. No.: 12/531,257

(22) PCT Filed: Mar. 13, 2008

(86) PCT No.: PCT/US2008/056864
§ 371 (c)(1),
(2), (4) Date: Mar. 25, 2010

(87) PCT Pub. No.: WO2008/112898
PCT Pub. Date: Sep. 18, 2008

(65) Prior Publication Data
US 2012/0095074 A1    Apr. 19, 2012

Related U.S. Application Data

(60) Provisional application No. 60/894,649, filed on Mar. 13, 2007, provisional application No. 60/910,019, filed on Apr. 4, 2007, provisional application No. 60/940,274, filed on May 25, 2007.

(51) Int. Cl.
*C12N 15/11* (2006.01)

(52) U.S. Cl.
USPC ......................................................... 514/44 A

(58) Field of Classification Search
USPC ......................................................... 514/44 A
See application file for complete search history.

(56) References Cited

PUBLICATIONS

Stratagene Catalog, p. 39 (1988).*
Bekris, L.M., et al. "Glutahione-s-transferase M1 and T1 polymorphisms and associations with type 1 diabetes age-at-onset." Autoimmunity, 38(8): 567-575 (Dec. 2005).

* cited by examiner

*Primary Examiner* — Brian Whiteman
(74) *Attorney, Agent, or Firm* — Dann, Dorfman, Herrell & SKillman; Kathleen D. Rigaut

(57) ABSTRACT

Compositions and methods for the detection and treatment of T1D are provided.

3 Claims, 16 Drawing Sheets

Figure 2

Sequence information for RPS26 (NM_001029)

A) Nucleic Acid (SEQ ID NO: 1) coding 266-613

```
  1 ggagacacat aacctcgatt ttcttccgcc atccggctaa atagtcccat gtgcactttg
 61 ttccatggat aaataaacac taggaacgca tttccaccct agatttcagc agaaatgctg
121 aatgtaaagg aatatttgag taaagtgagt tgccgttctt gaagcccgtc tcctaaggat
181 tctcccggtg tccgcgtagg gatctcatgc tatataggag ggccctgcca ggcaccgtct
241 cctctctccg gtccgtgcct ccaagatgac aaagaaaaga aggaacaatg gtcgtgccaa
301 aaagggccgc ggccacgtgc agcctattcg ctgcactaac tgtgcccgat gcgtgcccaa
361 ggacaaggcc attaagaaat tcgtcattcg aaacatagtg gaggccgcag cagtcaggga
421 catttctgaa gcgagcgtct tcgatgccta tgtgcttccc aagctgtatg tgaagctaca
481 ttactgtgtg agttgtgcaa ttcacagcaa agtagtcagg aatcgatctc gtgaagcccg
541 caaggaccga acacccccac cccgatttag acctgcgggt gctgccccac gtcccccacc
601 aaagcccatg taaggagctg agttcttaaa gactgaagac aggctattct ctggagaaaa
661 ataaaatgga aattgtactt aaaaaaaaaa aaaaaaaa
```

B) Protein (SEQ ID NO: 2)

MTKKRRNNGRAKKGRGHVQPIRCTNCARCVPKDKAIKKFVIRNI
VEAAAVRDISEASVFDAYVLPKLYVKLHYCVSCAIHSKVVRNRSR
EARKDRTPPPRFRPAGAAPRPPPKPM

Figure 3A

Sequence information for CDK2 (NM_052827)

A) Nucleic Acid (SEQ ID NO: 3) coding 238-1032

```
   1 gcgggaagca ggggcggggc ctctggtggc ggtcgggaac tcggtgggag gcggcaacat
  61 tgtttcaagt tggccaaatt gacaagagcg agaggtatac tgcgttccat cccgacccgg
 121 ggccacggta ctgggccctg tttccccctc ctcggccccc gagagccagg gtccgccttc
 181 tgcagggttc ccaggccccc gctccagggc cgggctgacc cgactcgctg gcgcttcatg
 241 gagaacttcc aaaaggtgga aaagatcgga gagggcacgt acggagttgt gtacaaagcc
 301 agaaacaagt tgacgggaga ggtggtggcg cttaagaaaa tccgcctgga cactgagact
 361 gagggtgtgc ccagtactgc catccgagag atctctctgc ttaaggagct taaccatcct
 421 aatattgtca agctgctgga tgtcattcac acagaaaata aactctacct ggttttgaa
 481 tttctgcacc aagatctcaa gaaattcatg gatgcctctg ctctcactgg cattcctctt
 541 cccctcatca agagctatct gttccagctg ctccagggcc tagctttctg ccattctcat
 601 cgggtcctcc accgagacct taaacctcag aatctgctta ttaacacaga gggggccatc
 661 aagctagcag actttggact agccagagct tttggagtcc ctgttcgtac ttacacccat
 721 gaggtgactc gccgggccct attccctgga gattctgaga ttgaccagct cttccggatc
 781 tttcggactc tggggacccc agatgaggtg gtgtggccag gagttacttc tatgcctgat
 841 tacaagccaa gtttccccaa gtgggcccgg caagatttta gtaaagttgt acctccctg
 901 gatgaagatg gacggagctt gttatcgcaa atgctgcact acgacctaa caagcggatt
 961 tcggccaagg cagccctggc tcacccttc ttccaggatg tgaccaagcc agtacccat
1021 cttcgactct gatagccttc ttgaagcccc cagccctaat ctcaccctct cctccagtgt
1081 gggcttgacc aggcttggcc ttgggctatt tggactcagg tgggccctct gaacttgcct
1141 taaacactca cctctagtc ttggccagcc aactctggga atacaggggt gaaaggggg
1201 aaccagtgaa aatgaaagga agtttcagta ttagatgcac ttaagttagc ctccaccacc
1261 ctttccccct tctcttagtt attgctgaag agggttggta taaaaataat tttaaaaaag
1321 ccttcctaca cgttagattt gccgtaccaa tctctgaatg ccccataatt attatttcca
1381 gtgtttggga tgaccaggat cccaagcctc ctgctgccac aatgtttata aaggccaaat
1441 gatagcgggg gctaagttgg tgcttttgag aaccaagtaa aacaaaacca ctgggaggag
1501 tctatttaa agaattcggt tgaaaaaata gatccaatca gtttataccc tagttagtgt
1561 tttgcctcac ctaataggct gggagactga agactcagcc cgggtggggc tgcagaaaaa
1621 tgattggccc cagtcccctt gtttgtccct tctacaggca tgaggaatct gggaggccct
1681 gagacaggga ttgtgcttca ttccaatcta ttgcttcacc atggccttat gaggcaggtg
1741 agagatgttt gaattttct cttcctttta gtattcttag ttgttcagtt gccaaggatc
1801 cctgatccca ttttcctctg acgtccacct cctacccat aggagttaga agttagggtt
1861 taggcatcat tttgagaatg ctgacacttt ttcagggctg tgattgagtg agggcatggg
1921 taaaaatatt tctttaaaag aaggatgaac aattatattt atatttcagg ttatatccaa
1981 tagtagagtt ggcttttttt tttttttttt ggtcataglg ggtggatttg ttgccatgtg
2041 caccttgggg ttttgtaatg acagtgctaa aaaaaaaaag cattttttt ttatgatttg
2101 tctctgtcac ccttgtcctt gagtgctctt gctattaacg ttatttgtaa tttagtttgt
2161 agctcattaa aaaaatgtgc ctagtttat aaaaaaaaa aaaaaaaca aaaaaaaa
2221 aaa
```

Figure 3B
Sequence information for CDK2 (NM_001798)
B) Nucleic Acid (SEQ ID NO: 4) coding 238-1134

```
   1 gcgggaagca ggggcggggc ctctggtggc ggtcgggaac tcggtgggag gcggcaacat
  61 tgtttcaagt tggccaaatt gacaagagcg agaggtatac tgcgttccat cccgacccgg
 121 ggccacggta ctgggccctg tttccccctc ctcggccccc gagagccagg gtccgccttc
 181 tgcagggttc ccaggccccc gctccagggc cgggctgacc cgactcgctg gcgcttcatg
 241 gagaacttcc aaaaggtgga aaagatcgga gagggcacgt acggagttgt gtacaaagcc
 301 agaaacaagt tgacgggaga ggtggtggcg cttaagaaaa tccgcctgga cactgagact
 361 gagggtgtgc ccagtactgc catccgagag atctctctgc ttaaggagct taaccatcct
 421 aatattgtca agctgctgga tgtcattcac acagaaaata aactctacct ggttttttgaa
 481 tttctgcacc aagatctcaa gaaattcatg gatgcctctg ctctcactgg cattcctctt
 541 cccctcatca gagctatct gttccagctg ctccagggcc tagctttctg ccattctcat
 601 cgggtcctcc accgagacct taaacctcag aatctgctta ttaacacaga ggggggccatc
 661 aagctagcag actttggact agccagagct tttggagtcc ctgttcgtac ttacacccat
 721 gaggtggtga ccctgtggta ccgagctcct gaaatcctcc tgggctgcaa atattattcc
 781 acagctgtgg acatctggag cctgggctgc atctttgctg agatggtgac tcgccgggcc
 841 ctattccctg gagattctga gattgaccag ctcttccgga tctttcggac tctggggacc
 901 ccagatgagg tggtgtggcc aggagttact tctatgcctg attacaagcc aagtttcccc
 961 aagtgggccc ggcaagattt tagtaaagtt gtacctcccc tggatgaaga tggacggagc
1021 ttgttatcgc aaatgctgca ctacgaccct aacaagcgga tttcggccaa ggcagccctg
1081 gctcacccctt tcttccagga tgtgaccaag ccagtacccc atcttcgact ctgatagcct
1141 tcttgaagcc cccagcccta atctcaccct ctcctccagt gtgggcttga ccaggcttgg
1201 ccttgggcta tttggactca ggtgggccct ctgaacttgc cttaaacact caccttctag
1261 tcttggccag ccaactctgg gaatacaggg gtgaaagggg ggaaccagtg aaaatgaaag
1321 gaagtttcag tattagatgc acttaagtta gcctccacca ccctttcccc cttctcttag
1381 ttattgctga agagggttgg tataaaaata attttaaaaa gccttccta cacgttagat
1441 ttgccgtacc aatctctgaa tgccccataa ttattatttc cagtgtttgg gatgaccagg
1501 atcccaagcc tcctgctgcc acaatgttta taaaggccaa atgatagcgg gggctaagtt
1561 ggtgcttttg agaaccaagt aaaacaaaac cactgggagg agtctatttt aaagaattcg
1621 gttgaaaaaa tagatccaat cagtttatac cctagttagt gttttgcctc acctaatagg
1681 ctgggagact gaagactcag cccgggtggg gctgcagaaa aatgattggc cccagtcccc
1741 ttgtttgtcc cttctacagg catgaggaat ctgggaggcc ctgagacagg gattgtgctt
1801 cattccaatc tattgcttca ccatggcctt atgaggcagg tgagagatgt ttgaattttt
1861 ctcttccttt tagtattctt agttgttcag ttgccaagga tccctgatcc cattttcctc
1921 tgacgtccac ctcctacccc ataggagtta gaagttaggg tttaggcatc attttgagaa
1981 tgctgacact ttttcagggc tgtgattgag tgagggcatg ggtaaaaata tttctttaaa
2041 agaaggatga acaattatat ttatatttca ggttatatcc aatagtagag ttggctttt
2101 tttttttttt ttggtcatag tgggtggatt tgttgccatg tgcaccttgg ggttttgtaa
2161 tgacagtgct aaaaaaaaaa agcatttttt ttttatgatt tgtctctgtc acccttgtcc
2221 ttgagtgctc ttgctattaa cgttatttgt aatttagttt gtagctcatt aaaaaaatgt
2281 gcctagtttt ataaaaaaaa aaaaaaaaaa caaaaaaaaa aaaaa
```

Figure 4A

Sequence information for ERBB3 (NM_001005915)

A) Nucleic Acid (SEQ ID NO: 5) coding 194-745

```
   1  acacacacac acccctcccc tgccatccct ccccggactc cggctccggc tccgattgca
  61  atttgcaacc tccgctgccg tcgccgcagc agccaccaat tcgccagcgg ttcaggtggc
 121  tcttgcctcg atgtcctagc ctaggggccc ccgggccgga cttggctggg ctcccttcac
 181  cctctgcgga gtcatgaggg cgaacgacgc tctgcaggtg ctgggcttgc ttttcagcct
 241  ggcccggggc tccgaggtgg gcaactctca ggcagtgtgt cctgggactc tgaatggcct
 301  gagtgtgacc ggcgatgctg agaaccaata ccagacactg tacaagctct acgagaggtg
 361  tgaggtggtg atggggaacc ttgagattgt gctcacggga cacaatgccg acctctcctt
 421  cctgcagtgg attcgagaag tgacaggcta tgtcctcgtg gccatgaatg aattctctac
 481  tctaccattg cccaacctcc gcgtggtgcg agggacccag gtctacgatg ggaagtttgc
 541  catcttcgtc atgttgaact ataacaccaa ctccagccac gctctgcgcc agctccgctt
 601  gactcagctc accggtcagt cccgatggt tccttctggc ctcacccctc agccagccca
 661  agactggtac ctccttgatg atgacccaag actgctcact ctaagtgcct cttccaaggt
 721  gcctgtcacc ttggccgctg tctaaaggtc cattgctccc taagcaatag agggccccca
 781  gtaggggag ctaggggcat ctgctccagg gaaaggaacc ctgtgtcctt gtggggctgg
 841  agtcagagct ggatctgtta accgttttc taatttcaaa gtacagtgta ccggaggcca
 901  ggcctgatgg cttacacctg taatcccagc attttgggag gccaaggagg gcagatcact
 961  tgagatcagg agtttgagac cagcctggcc aacatggcga aaccctgtct ctactaaaaa
1021  tacaaaaaaa taaaataaaa taaaaaatta
```

Figure 4B

Sequence information for ERBB3 (NM_001982)

B) Nucleic Acid (SEQ ID NO: 6) coding 194-4222

```
   1  acacacacac  accccteccc  tgccatccct  ccccggactc  cggctccggc  tccgattgca
  61  atttgcaacc  tccgctgccg  tcgccgcagc  agccaccaat  tcgccagcgg  ttcaggtggc
 121  tcttgcctcg  atgtcctagc  ctaggggccc  ccgggccgga  cttggctggg  ctcccttcac
 181  cctctgcgga  gtcatgaggg  cgaacgacgc  tctgcaggtg  ctgggcttgc  ttttcagcct
 241  ggcccggggc  tccgaggtgg  gcaactctca  ggcagtgtgt  cctgggactc  tgaatggcct
 301  gagtgtgacc  ggcgatgctg  agaaccaata  ccagacactg  tacaagctct  acgagaggtg
 361  tgaggtggtg  atggggaacc  ttgagattgt  gctcacggga  cacaatgccg  acctctcctt
 421  cctgcagtgg  attcgagaag  tgacaggcta  tgtcctcgtg  gccatgaatg  aattctctac
 481  tctaccattg  cccaacctcc  gcgtggtgcg  agggaccccag  gtctacgatg  ggaagtttgc
 541  catcttcgtc  atgttgaact  ataacaccaa  ctccagccac  gctctgcgcc  agctccgctt
 601  gactcagctc  accgagattc  tgtcaggggg  tgtttatatt  gagaagaacg  ataagctttg
 661  tcacatggac  acaattgact  ggagggacat  cgtgagggac  cgagatgctg  agatagtggt
 721  gaaggacaat  ggcagaagct  gtccccccctg  tcatgaggtt  tgcaagggc  gatgctgggg
 781  tcctggatca  gaagactgcc  agacattgac  caagaccatc  tgtgctcctc  agtgtaatgg
 841  tcactgcttt  gggcccaacc  ccaaccagtg  ctgccatgat  gagtgtgccg  ggggctgctc
 901  aggccctcag  gacacagact  gctttgcctg  ccggcacttc  aatgacagtg  gagcctgtgt
 961  acctcgctgt  ccacagcctc  ttgtctacaa  caagctaact  ttccagctgg  aacccaatcc
1021  ccacaccaag  tatcagtatg  gaggagtttg  tgtagccagc  tgtccccata  actttgtggt
1081  ggatcaaaca  tcctgtgtca  gggcctgtcc  tcctgacaag  atggaagtag  ataaaaatgg
1141  gctcaagatg  tgtgagcctt  gtgggggact  atgtcccaaa  gcctgtgagg  gaacaggctc
1201  tgggagccgc  ttccagactg  tggactcgag  caacattgat  ggatttgtga  actgcaccaa
1261  gatcctgggc  aacctggact  tctgatcac  cggcctcaat  ggagacccct  ggcacaagat
1321  ccctgccctg  gacccagaga  agctcaatgt  cttccggaca  gtacgggaga  tcacaggtta
1381  cctgaacatc  cagtcctggc  cgccccacat  gcacaacttc  agtgtttttt  ccaatttgac
1441  aaccattgga  ggcagaagcc  tctacaaccg  gggcttctca  ttgttgatca  tgaagaactt
1501  gaatgtcaca  tctctgggct  tccgatccct  gaaggaaatt  agtgctgggc  gtatctatat
1561  aagtgccaat  aggcagctct  gctaccacca  ctctttgaac  tggaccaagg  tgcttcgggg
1621  gcctacggaa  gagcgactag  acatcaagca  taatcggccg  cgcagagact  gcgtggcaga
1681  gggcaaagtg  tgtgacccac  tgtgctcctc  tggggggatgc  tggggcccag  gccctggtca
1741  gtgcttgtcc  tgtcgaaatt  atagccgagg  aggtgtctgt  gtgacccact  gcaactttct
1801  gaatgggag  cctcgagaat  tgcccatga  ggccgaatgc  ttctcctgcc  acccggaatg
1861  ccaacccatg  gagggcactg  ccacatgcaa  tggctcgggc  tctgatactt  gtgctcaatg
1921  tgcccatttt  cgagatgggc  cccactgtgt  gagcagctgc  ccccatggag  tcctaggtgc
1981  caagggccca  atctacaagt  acccagatgt  tcagaatgaa  tgtcggccct  gccatgagaa
2041  ctgcacccag  gggtgtaaag  gaccagagct  tcaagactgt  ttaggacaaa  cactggtgct
2101  gatcggcaaa  acccatctga  caatggcttt  gacagtgata  gcaggattgg  tagtgatttt
2161  catgatgctg  ggcggcactt  ttctctactg  gcgtgggcgc  cggattcaga  ataaagggc
2221  tatgaggcga  tacttggaac  ggggtgagag  catagagcct  ctggacccca  gtgagaaggc
```

Figure 4B continued 2281 taacaaagtc ttggccagaa tcttcaaaga gacagagcta aggaagctta aagtgcttgg
2341 ctcgggtgtc tttggaactg tgcacaaagg agtgtggatc cctgagggtg aatcaatcaa
2401 gattccagtc tgcattaaag tcattgagga caagagtgga cggcagagtt ttcaagctgt
2461 gacagatcat atgctggcca ttggcagcct ggaccatgcc cacattgtaa ggctgctggg
2521 actatgccca gggtcatctc tgcagcttgt cactcaatat ttgcctctgg gttctctgct
2581 ggatcatgtg agacaacacc gggggggcact ggggccacag ctgctgctca actggggagt
2641 acaaattgcc aagggaatgt actaccttga ggaacatggt atggtgcata gaaacctggc
2701 tgcccgaaac gtgctactca agtcacccag tcaggttcag gtggcagatt ttggtgtggc
2761 tgacctgctg cctcctgatg ataagcagct gctatacagt gaggccaaga ctccaattaa
2821 gtggatggcc cttgagagta tccactttgg gaaatacaca caccagagtg atgtctggag
2881 ctatggtgtg acagtttggg agttgatgac cttcggggca gagccctatg cagggctacg
2941 attggctgaa gtaccagacc tgctagagaa gggggagcgg ttggcacagc cccagatctg
3001 cacaattgat gtctacatgg tgatggtcaa gtgttggatg attgatgaga acattcgccc
3061 aaccttaaaa gaactagcca atgagttcac caggatggcc cgagacccac cacggtatct
3121 ggtcataaag agagagagtg ggcctggaat agcccctggg ccagagcccc atggtctgac
3181 aaacaagaag ctagaggaag tagagctgga gccagaacta gacctagacc tagacttgga
3241 agcagaggag gacaacctgg caaccaccac actgggctcc gccctcagcc taccagttgg
3301 aacacttaat cggccacgtg ggagccagag ccttttaagt ccatcatctg gatacatgcc
3361 catgaaccag ggtaatcttg gggagtcttg ccaggagtct gcagtttctg ggagcagtga
3421 acggtgcccc cgtccagtct ctctacaccc aatgccacgg ggatgcctgg catcagagtc
3481 atcagagggg catgtaacag gctctgaggc tgagctccag gagaaagtgt caatgtgtag
3541 gagccggagc aggagccgga gccacggcc acgcggagat agcgcctacc attcccagcg
3601 ccacagtctg ctgactcctg ttaccccact ctccccaccc gggttagagg aagaggatgt
3661 caacggttat gtcatgccag atacacacct caaaggtact ccctcctccc gggaaggcac
3721 cctttcttca gtgggtctca gttctgtcct gggtactgaa gaagaagatg aagatgagga
3781 gtatgaatac atgaaccgga ggagaaggca cagtccacct catcccccta ggccaagttc
3841 ccttgaggag ctgggttatg agtacatgga tgtggggtca gacctcagtg cctctctggg
3901 cagcacacag agttgcccac tccaccctgt acccatcatg cccactgcag gcacaactcc
3961 agatgaagac tatgaatata tgaatcggca acgagatgga ggtggtcctg ggggtgatta
4021 tgcagccatg gggggcctgcc cagcatctga gcaagggtat gaagagatga gagcttttca
4081 ggggcctgga catcaggccc ccatgtcca ttatgcccgc ctaaaaactc tacgtagctt
4141 agaggctaca gactctgcct ttgataaccc tgattactgg catagcaggc ttttccccaa
4201 ggctaatgcc cagagaacgt aactcctgct ccctgtggca ctcagggagc atttaatggc
4261 agctagtgcc tttagagggt accgtcttct ccctattccc tctctctccc aggtcccagc
4321 ccctttccc cagtcccaga caattccatt caatctttgg aggcttttaa acattttgac
4381 acaaaattct tatggtatgt agccagctgt gcactttctt ctctttccca accccaggaa
4441 aggttttcct tattttgtgt gctttcccag tccattcct cagcttcttc acaggcactc
4501 ctggagatat gaaggattac tctccatatc ccttcctctc aggctcttga ctacttggaa
4561 ctaggctctt atgtgtgcct tgtttccca tcagactgtc aagaagagga aagggaggaa
4621 acctagcaga ggaaagtgta attttggttt atgactctta accccctaga aagacagaag
4681 cttaaaatct gtgaagaaag aggttaggag tagatattga ttactatcat aattcagcac
4741 ttaactatga gccaggcatc atactaaact tcacctacat tatctcactt agtcctttat
4801 catccttaaa acaattctgt gacatacata ttatctcatt ttacacaaag ggaagtcggg

Figure 4B continued

```
4861 catggtggct catgcctgta atctcagcac tttgggaggc tgaggcagaa ggattacctg
4921 aggcaaggag tttgagacca gcttagccaa catagtaaga cccccatctc tttaaaaaaa
4981 aaaaaaaaaa aaaaaaaaaa actttagaac tgggtgcagt ggctcatgcc tgtaatccca
5041 gccagcactt tgggaggctg agatgggaag atcacttgag cccagaatta gagataagcc
5101 tatggaaaca tagcaagaca ctgtctctac aggggaaaaa aaaaaaagaa actgagcctt
5161 aaagagatga aataaattaa gcagtagatc caggatgcaa aatcctccca attcctgtgc
5221 atgtgctctt attgtaaggt gccaagaaaa actgatttaa gttacagccc ttgtttaagg
5281 ggcactgttt cttgttttg cactgaatca agtctaaccc caacagccac atcctcctat
5341 acctagacat ctcatctcag gaagtggtgg tggggtagt cagaaggaaa aataactgga
5401 catctttgtg taaaccataa tccacatgtg ccgtaaatga tcttcactcc ttatccgagg
5461 gcaaattcac aaggatcccc aagatccact tttagaagcc attctcatcc a
```

Figure 5

Sequence information for IKZF4 (NM_022465)
Nucleic Acid (SEQ ID NO: 7) coding 590-2347

```
   1   gaagctgtcc gtgtcctggg ccccatgacc tctggggcct tggcttcccc agctggcaga
  61   ggattgggcc ttccctaggg ccccccnctt ctccctccca cccgcaggcc catccatctc
 121   tctctctctc tcttgcacac actcttgcct ctctcaggca tttgttgtgc agttcctctt
 181   tgtctgctgg gcacgagggg caacagcatc tgcctttccc tccctgtgca cacacccacc
 241   acccacccccc ttcactgtct tggaaaaggg atgctgtagc ctagcatctc ccccactata
 301   tacacatata cattctctcc agcccctcc ccaagcacat ccaagcgtgc tctcccctct
 361   ccttctctcc ctctctctct ctctctctct cacacacaca cacacacaca cactcaacac
 421   acatacaccc tgggctgagc tgctcttgct ggctgcagcc gtgggcctct gctcaccgtg
 481   ccgctgctgc tgcctgcgaa atgacggcgg ttcccctcac ttccaggaat ccacgcttcc
 541   tggaaggtga gtggctgggc tcaccccttg ctgccactga gacgcagaca tgcatacacc
 601   acccgcactc cctcgccgtt tccaaggcgg cggccgcgtt cgcaccccag ggtctcaccg
 661   gcaagggaag gataatctgg agagggatcc ctcaggaggg tgtgttccgg atttcttgcc
 721   tcaggcccaa gactccaacc attttataat ggaatcttta ttttgtgaaa gtagcgggga
 781   ctcatctctg gagaaggagt tcctcggggc cccagtgggg ccctcggtga gcacccccaa
 841   cagccagcac tcttctccta gccgctcact cagtgccaac tccatcaagg tggagatgta
 901   cagcgatgag gagtcaagca gactgctggg gccagatgag cggctcctgg aaaaggacga
 961   cagcgtgatt gtggaagatt cattgtctga gccctgggc tactgtgatg ggagtgggcc
1021   agagcctcac tcccctgggg gcatccggct gcccaatggc aagctcaagt gtgacgtctg
1081   cggcatggtc tgtattggac ccaacgtgct catggtgcac aagcgcagtc acactggtga
1141   aaggcccttc cattgcaacc agtgtggtgc ctccttcacc cagaagggga acctgctgcg
1201   ccacatcaag ctgcactctg gggagaagcc ctttaaatgt ccttctgca actatgcctg
1261   ccgccggcgt gatgcactca ctggtcacct ccgcacacac tcagtctcct ctcccacagt
1321   gggcaagccc tacaagtgta actactgtgg ccggagctac aaacagcaga gtaccctgga
1381   ggagcacaag gagcggtgcc ataactacct acagagtctc agcactgaag cccaagcttt
1441   ggctggccaa ccaggtgacg aaatacgtga cctggagatg gtgccagact ccatgctgca
1501   ctcatcctct gagcggccaa ctttcatcga tcgtctggcc aatagcctca caaaacgcaa
1561   gcgttccaca ccccagaagt ttgtaggcga aaagcagatg cgcttcagcc tctcagacct
1621   ccccctatgat gtgaactcgg gtggctatga aaaggatgtg gagttggtgg cacaccacag
1681   cctagagcct ggctttggaa gttccctggc ctttgtgggt gcagagcatc tgcgtcccct
1741   ccgccttcca cccaccaatt gcatctcaga actcacgcct gtcatcagct ctgtctacac
1801   ccagatgcag cccctccctg gtcgactgga gcttccagga tcccgagaag caggtgaggg
1861   acctgaggac ctggctgatg gaggtcccct cctctaccgg ccccgaggcc ccctgactga
1921   ccctggggca tcccccagca atggctgcca ggactccaca gacacagaaa gcaaccacga
1981   agatcgggtt gcggggggtgg tatccctccc tcagggtccc ccaccccagc cacctcccac
2041   cattgtggtg ggccggcaca gtcctgccta cgccaaagag gaccccaagc cacaggaggg
2101   gttattgcgg ggcaccccag gcccctccaa ggaagtgctt cgggtggtgg gcgagagtgg
2161   tgagcctgtg aaggccttca agtgtgagca ctgccgtatc ctcttcctgg accacgtcat
2221   gttcactatc cacatgggct gccatggctt cagagaccct tttgagtgca acatctgtgg
2281   ttatcacagc caggaccggt acgaattctc ttcccacatt gtccgggggg agcataaggt
```

Figure 5 continued

```
2341 gggctagcaa cctctccctc tctcctcagt ccaccactcc actgccctga ctacaggcat
2401 tgatccctgt ccccaccatt tcccaaggag ttttgctttg tagccctcac tactggccac
2461 ctgacctcac acctgaccct gacccctcct cacctattct cttcctctat cctgaccgat
2521 gtaagcattg tgatgaaaca gatcttttgc ttatgttttt ccttttate ttctctcatc
2581 ccagcatact gagttattta ttaattagtt gatttatttt tgccttttta aattttaact
2641 tatatcagtc acttgccact cccccaccct cctgtccaca actcctttcc actttaggcc
2701 aatttttctc tcttagatct tccagcagcc ccaggggtag gaagctcctc ttagtactaa
2761 gagacttcaa gcttcttgct ttaagtcctc acccttttaca ttatctaatt cttcagtttt
2821 gatgctgata cctgcccccg gccctaccit agctctgtgg cattatatct cctctctggg
2881 actcttcaac ctggtactcc atacctcttg tgccctctca ctttaggcag cttgcactat
2941 tcttgaatga atgaagaatt atttcctcat ttggaagtag gagggactga agaaattctc
3001 cccaggcact gtgggactga gagtccatt cccctagtaa taggtcatat tcccctagta
3061 atatgagttc tcaaagccta cattcaggat ctccctctag gatgtgatag atctggtccc
3121 tctccttgaa ctaccectcc acacgctcta gtccttcaa cctaccggtc tattaagtgg
3181 tggcttttct ctccttggag tgccccaatt ttatattctc aggggccaag gctaggtctg
3241 caaccctctg tctctgacag attgggagcc acaggtgcct aattgggaac cagggcatgg
3301 gaaaggagtg ggtcaaaatt cttctctttc tcctccacct ctcaaacttc ttcactatag
3361 tgaccttcct aggctctcag gggctccttc agtccccatc ctatgagaaa ctagtgggtt
3421 gctgcctgat gacaagggg tgtttcagcc cctcagtcat gctgccttct gctgctccct
3481 cccagcagga ttcaccctct cattcccggg ctcctgggcc ctgttcttag gatcagtggc
3541 agggagaaac gggtatctct tttctctctt ctaattttca gtataaccaa aaattatccc
3601 agcatgagca cgggcacgtg cccttcaccc cattccaccc ttgttccagc aagactggga
3661 tgggtacaac tgaactgggg tcttcctta ctacccectt ctacactcag ctcccagaca
3721 cagggtagga ggggggactg ctggctactg cagagaccct tggctatttg agtaacctag
3781 gattagtgag aaggggcaga aggagataca actccactgc aagtggaggt ttctttctac
3841 aagagttttc tgcccaaggc cacagccatc ccactctctg cttccttgag attcaaacca
3901 aaggctgttt ttctatgttt aaagaaaaaa aaaagtaaaa accaaacaca acacctcaca
3961 agttgtaact cttggtccit ctctctctcc ttttctcttc ccttccttcc ccttccatct
4021 ttcttccac atgtcctttc cttattggct cttttacctc ctactttct cactccctat
4081 cagggatatt ttgggggggg atggtaaagg gtgggctaag gaacagaccc tgggattagg
4141 gccttaaggg ctctgagagg agtctacctt gccttcttat gggaagggag accctaaaaa
4201 actttctcct ctttgtcctc cttttctcc cccactctga ggtttcccca agagaaccag
4261 attggcaggg agaagcattg tggggcaatt gttcctcctt gacaatgtag caataaatag
4321 atgctgccaa gggcagaaaa tggggaggtt agctcagagc agagtagtct ctagagaaag
4381 gaagaatcct caacggcacc ctggggtgct agctcctttt tagaatgtca gcagagctga
4441 gattaatatc tgggcttttc ctgaactatt ctggttattg agcccttcct gttagaccta
4501 ccgcctccca cctcttctgt gtctgctgtg tatttggtga cacttcataa ggactagtcc
4561 cttctggggt atcagagcct tagggtgccc ccatcccctt ccccagtcaa ctgtggcacc
4621 tgtaacctcc cggaacatga aggactatgc tctgaggcta tactctgtgc ccatgagagc
4681 agagactgga agggcaagac caggtgctaa ggaggggaga gggggcatcc tgtctctctc
4741 cagaccatca ctgcactta accagggtct taggtacaaa atcctacttt tcagagcctt
4801 ccagctctgg aacctcaaac atcctcatgc tctctcccag ctcctttgc ataaaaaaaa
```

Figure 5 continued

```
4861 aagtaaagaa aaagaaaaaa aaatacacac acactgaaac ccacatggag aaaagaggtg
4921 tttcctttta tattgctatt caaaatcaat accaccaaca aaatatttct aagtagacac
4981 ttttccagac ctttgttttt ttgtgtcagt gtccaagctg cagataggat tttgtaatac
5041 ttctggcagc ttctttcctt gtgtacataa tatatatata tacatatata tatatatttt
5101 taatcagaag ttatgaagaa caaaaagaaa aaataaacac agaagcaagt gcaataccac
5161 ctctcttctc cctctctcct agggtttcct ttgtagccta tgtttggtgt ctcttttgac
5221 ctttacccct tcacctcctc ctctcttctt ctgattcccc tcccccccctt ttttaaagag
5281 ttttctcct ttctcaaggg gagttaaact agcttttgag acttattgca aagcattttg
5341 tatatgtaat atattgtaag taaatatttg tgtaacggag atatactact gtaagttttg
5401 tactgtactg gctgaaagtc tgttataaat aaacatgagt aatttaacac caaaaaaaaa
5461 aaaaaaaaaa aaaaaaaaaa aaaaaaaaaa aaaaaaaaaa aaaaaa
```

Figure 6

Sequence information for RAB5B (NM_002868)

Nucleic Acid (SEQ ID NO: 8) coding 266-613

```
  1  ggagacacat aacctcgatt ttcttccgcc atccggctaa atagtcccat gtgcactttg
 61  ttccatggat aaataaacac taggaacgca tttccaccct agatttcagc agaaatgctg
121  aatgtaaagg aatatttgag taaagtgagt tgccgttctt gaagcccgtc tcctaaggat
181  tctcccggtg tccgcgtagg gatctcatgc tatataggag ggccctgcca ggcaccgtct
241  cctctctccg gtccgtgcct ccaagatgac aaagaaaaga aggaacaatg gtcgtgccaa
301  aaagggccgc ggccacgtgc agcctattcg ctgcactaac tgtgcccgat gcgtgcccaa
361  ggacaaggcc attaagaaat tcgtcattcg aaacatagtg gaggccgcag cagtcaggga
421  catttctgaa gcgagcgtct tcgatgccta tgtgcttccc aagctgtatg tgaagctaca
481  ttactgtgtg agttgtgcaa ttcacagcaa agtagtcagg aatcgatctc gtgaagcccg
541  caaggaccga acacccccac cccgatttag acctgcgggt gctgccccac gtcccccacc
601  aaagcccatg taaggagctg agttcttaaa gactgaagac aggctattct ctggagaaaa
661  ataaaatgga aattgtactt aaaaaaaaaa aaaaaaaa
```

Figure 7A

Sequence information for SUOX (NM_000456)
A) Nucleic Acid (SEQ ID NO: 9) coding 156-803

```
   1   ggagctgcag ctgtttgtct gttcgacaca ggcttggggc cgacggggga gacggagccc
  61   caggagtgtt gaagcctgga aatcccctcc ccttccccct cccccctta cagtatcccc
 121   ctccctccac cctttcccat tctgataatc tggccatgac tagcagaagc acagctaggc
 181   ccaatgggca accccaggcc agcaaaattt gccagttcaa attggtcctg ctgggagaat
 241   ctgcagtggg aaagtcaagc ctggtattac gttttgtcaa agggcagttc catgagtacc
 301   aggagagcac cattggagcg gccttcctca cccagtccgt ttgtctagat gacacaacag
 361   tgaagtttga gatctgggac acagctgggc aggagcgata tcacagctta gcccccatgt
 421   actacagggg tgcccaagct gcaatcgtgg tttacgacat tactaatcag gaaaccttig
 481   cccgagcaaa gacatgggtg aaggaactac agcgacaggc cagtcctagc atcgttattg
 541   ccctggcagg gaacaaagct gacctggcca acaaacgtat ggtggagtat gaagaggccc
 601   aggcatatgc agatgacaac agcttattgt tcatggagac ttcagccaag acagctatga
 661   acgtgaatga tctcttcctg gcaatagcta agaagttgcc aaagagtgaa ccccagaatc
 721   tgggaggtgc agcaggccga agccgggggtg tggatctcca tgaacagtcc cagcagaaca
 781   agagccagtg ttgtagcaac tgaggggggtg gctagcagca aacaagtatg gagctagcac
 841   aagagctaag aaataacctc catccctacc cctcagcaca caaccccctac ggtaacagca
 901   cactgagccc tggctcccaa gggctgcctc ctgacagctc cgtcatggca cttttttaacg
 961   cttcagcaac aaacaccagg cagctgttgc cactggcctc ctaccccta ctctggggct
1021   tgggggtcaa ctcccccccag gacttacctt ccaaaacaaa ctttcttcac tttgtattat
1081   aggtacaaga cagcgactta cgtatctttt ctcctcctcc ctagtgttcc tccccatttt
1141   ttcagaaaac acttctgact cctgtccctt ccccttctgc ttttggtcag tccctgttct
1201   tgagcctctt ttctcctctc cccaggatgc agaaagtggt gaacccagga actgaggaag
1261   gaggtttcca gttcatttac attaagggcc ctgggggaga ataaagctca gagcaggagg
1321   gagtaaggaa acatttcctt tttgtttttta tttggttgga gtttctcata tttgaaaaca
1381   ttgcggtatc catgatttgg ccttgtggag ggtgttccta ggtagaggtg agaatgggga
1441   ggcaagatct caggcaccag gcaggaggtg ccttgtaagc taactgggcg gaggtggagg
1501   tgcagtgtca actgtggctc tgtaactctt caaaggccca gtttccctc acgcagcctc
1561   ttaggtagcg tttcccctaa tcgtgggggt tggaccccag agtcttccaa agaattttca
1621   ctggttgcct gcatctttgg ctctgctgtg atctgattgg aggagggaca gtttctggta
1681   cccatcctct gatttataca tatgcatttt ttcccctctg gcctttagat ggcctcagcc
1741   ccagccacca tatacccctg cagtttgcac tttaattgat ggtagttcag ttggggtact
1801   tgtttttatgg aagtttttgat tgatttactt gccctcccac cttctttta attcaatgaa
1861   atctgaggtt aatgcgaggt tcgaggagag gttatagata aaactaccag tggcagctac
1921   tcaagtccta tctccactgt tagcttcctc caactctaat tattaaccta tattcttgcc
1981   aagctaacta ttgactatag gtttgccttt cctggagaat taattgagca attgaggagt
2041   gtctcaggat agcacaggcc aaggtagggg agtaaaaagg aggtcaggca aagggagga
2101   gttttctgtc ctttcccagg tttcacactc aatttgatat ccattaccat gtctttcta
2161   cttccttgta aataggtatg atctttattc ccactgtaca gtctgttcta tcctctgcct
2221   cccatcaggc cctgtttctt tgttcctttg ttaatatctt gaatttagtc cctccatcct
```

Figure 7A continued 2281 taatcccccc atccctcccc atcatgcaac cagtggttta atccatgtac caataggggc
2341 tagtaccaca gaggcctcct gtggtgccct cgtatcatac cacctgttcc tgtggagagg
2401 gaatgaccgg cactgaaggt accttacaac tggctcatat tatcagagga ccttggtcct
2461 ttctaaatct ctagtctctc ttcatatcct tcatcaggtg ttttaagatg tctctgagaa
2521 gccatcaagg caaaagagaa ctttaagttc cttgttccag cccggagttt tgggaaagaa
2581 agaaaggaaa ggtcacagtg acctaggatt ggaaccttcc tgccttttg gcttgcagac
2641 tgccttctat cccagaacag ctgagaaatc tatgaagctg agattctgaa ggacccagct
2701 taggttcttc cacttaggcc tcaattccct tccttttcca ggggcagcct tagttcccat
2761 ggccctgaaa cacacacatt tccccttcc tttcccagaa gccactggcc ccccatagca
2821 cccagtgcat ccttttaca agtggaagaa ctaggatggc tttccaaagt cttctagaaa
2881 tgaagttctt tctctgtgca gctttccccc ttggagcagg agtgaagatg tttcattatc
2941 ttgggcctgg gaaaccactt ccccaggctt ctccctcccc ccaccccat aggaacagga
3001 tttggcctta gcttctgggc ctatcggctg ccttccctct acttcctacc acctcttctg
3061 ccttcctttg agctctgttg ggcttgggga tcttagtttt cttttgttta tttcccagct
3121 cattttttc ttctggtcag ttttttaag gggggtgtt gtggttttt gtttttgttt
3181 tgcttctgag aaagcatttg cctttcttcc tctcccaaca taacaatcgt ggtaacagaa
3241 tgcgactgct gatttaccga tgtatttaat gtaagtaaaa aaaggaaaaa aagaaaaaaa
3301 aaaaaaaaaa aaaaaaaaaa aaaaaaaaaa aaaaaa

Figure 7B

Sequence information for SUOX (NM_001032386)

B) Nucleic Acid (SEQ ID NO: 10) coding 201-1838

```
   1   ataacggcgc tggccccgcc ccttctcgag aactcgcaga gctgggctgg taaaattgca
  61   gtgctgaaga cactggaccc gcaaaaggct gtccctccca aacctgggat tctgggctca
 121   ctgagttcac ctgcgagtca gccctacctg cactgctctg gtctagtaca aacaggctgc
 181   tggcattgag gtctgctaca atgctgctgc tgcacagagc tgtggtcctc aggctccaac
 241   aggcctgcag actcaagtca atcccctcaa ggatctgcat tcaggcctgc tccacaaatg
 301   attcatttca gccccagcgc cccagcctca ccttctctgg tgataactcc agcacccagg
 361   gatggagagt catggggacc ctattaggtc tcggtgcagt gttggcctat caggaccatc
 421   ggtgtagggc tgctcaggag tcaacacaca tatacactaa ggaggaagtg agttcccaca
 481   ccagccctga gactgggatc tgggtgactc tgggctctga ggtctttgat gtcacagaat
 541   ttgtggacct acatccaggg gggccttcaa agctgatgct agcagctggg ggtcccctag
 601   agcccttctg ggccctctat gctgttcaca accagtccca tgtgcgtgag ttactggctc
 661   agtacaagat tggggagctg aatcctgaag acaaggtagc ccccaccgtg gagacctctg
 721   acccttatgc tgatgatcct gtacgtcacc cagccctgaa ggtcaacagc cagcggccct
 781   ttaatgcaga gcctccccct gagctgctga cagaaaacta catcacaccc aaccctatct
 841   tcttcacccg gaaccatctg cctgtaccta acctggatcc agacacctat cgcttacacg
 901   tagtaggagc acctgggggt cagtcactgt ctctttccct ggatgacttg cacaactttc
 961   ccaggtacga gatcacagtc actctgcagt gtgccggcaa ccgacgctct gagatgactc
1021   aggtcaaaga agtaaaaggt ctggagtgga gaacaggagc catcagcact gcacgctggg
1081   ctggggcacg gctctgtgat gtgttagccc aggctggcca ccaactctgt gaaactgagg
1141   cccacgtctg ctttgaggga ctggactcag accctactgg gactgcctat ggagcatcca
1201   tccctctggc tcgggccatg gaccctgaag ctgaggtcct gctggcatat gagatgaatg
1261   ggcagcctct gccacgtgac cacggcttcc ctgtgcgtgt ggtggttcct ggagtggtgg
1321   gtgcccgcca tgtcaaatgg ctgggcagag tgagtgtgca gccagaggaa agttacagcc
1381   actggcaacg gcgggattac aaaggcttct ctccatctgt ggactgggag actgtagatt
1441   ttgactctgc tccatccatt caggaacttc ctgtccagtc ggccatcaca gagccccggg
1501   atggagagac tgtagaatca ggggaggtga ccatcaaggg ctatgcatgg agtggtggtg
1561   gcaggcctgt gatccgggtg gatgtgtctc tggatggggg cctaacctgg caggtggcta
1621   agctggatgg agaggaacag cgccccagga aggcctgggc atggcgtctg tggcagttga
1681   aagcccctgt gccagctgga caaaaggaac tgaacattgt ttgtaaggct gtggatgatg
1741   gttacaatgt gcagccagac accgtggccc caatctggaa cctgcgaggt gttctcagca
1801   atgcctggca tcgtgtccat gtctatgtct ccccatgagc atggaaagga gccacctcca
1861   ccccttccc cacccattag cctcactgct tcagaaaaat cttttcccacc tttcaacttc
1921   ttggatcaca actctggcct tcctaagcca tacccaagta cacatatagc acatttcacc
1981   caaggaccct ccctctttgg acactatgtt acatacccct cttggcctt gaacctgtgc
2041   caggaagtgt gagctgttac agcaaggggc tagaagtgaa aaaagtaatt ctggagacaa
2101   gcactatttt ctcttcctac cccacctcca tttctaatgc ctactgccat caaggccttg
2161   ttttgctttt cttttggat tgttcagaga aatgtgtgtg gcatgtgtaa gaaaagtgta
2221   tatactatct tatactacct ctccaggttg ccagagagtt gcgaggagag caaggggcac
2281   aaccgtctcc ctttatagtt ctactttct aataaatagt ctgtttaaga tcataaaaaa
2341   aaaaaaaaaa aaaaaaaaaa aaaaaaaaaa aaaaaaaaaa aaaaaaaaaa aaaaaaaaaa
2401   aaaaaaaaaa aaaaaaaaaa aaaaaaaaaa aaaaaaa
```

Figure 7C

Sequence information for SUOX (NM_001032387)
C) Nucleic Acid (SEQ ID NO: 11) coding 92-1729

```
1     ataacggcgc tggccccgcc ccttctcgag aactcgcaga gctgggctgg taaaattgca
61    gtgctgaaga cactggaccc ggtctgctac aatgctgctg ctgcacagag ctgtggtcct
121   caggctccaa caggcctgca gactcaagtc aatcccctca aggatctgca ttcaggcctg
181   ctccacaaat gattcatttc agccccagcg ccccagcctc accttctctg gtgataactc
241   cagcacccag ggatggagag tcatggggac cctattaggt ctcggtgcag tgttggccta
301   tcaggaccat cggtgtaggg ctgctcagga gtcaacacac atatacacta aggaggaagt
361   gagttcccac accagccctg agactgggat ctgggtgact ctgggctctg aggtctttga
421   tgtcacagaa tttgtggacc tacatccagg ggggccttca aagctgatgc tagcagctgg
481   gggtcccta gagcccttct gggccctcta tgctgttcac aaccagtccc atgtgcgtga
541   gttactggct cagtacaaga ttgggagct gaatcctgaa gacaaggtag cccccaccgt
601   ggagacctct gacccttatg ctgatgatcc tgtacgtcac ccagccctga aggtcaacag
661   ccagcggcc tttaatgcag agcctccccc tgagctgctg acagaaaact acatcacacc
721   caaccctatc ttcttcaccc ggaaccatct gcctgtacct aacctggatc cagacaccta
781   tcgcttacac gtagtaggag cacctggggg tcagtcactg tctctttccc tggatgactt
841   gcacaacttt cccaggtacg agatcacagt cactctgcag tgtgccggca accgacgctc
901   tgagatgact caggtcaaag aagtaaaagg tctggagtgg agaacaggag ccatcagcac
961   tgcacgctgg gctggggcac ggctctgtga tgtgttagcc caggctggcc accaactctg
1021  tgaaactgag gcccacgtct gctttgaggg actggactca gaccctactg ggactgccta
1081  tggagcatcc atccctctgg ctcgggccat ggaccctgaa gctgaggtcc tgctggcata
1141  tgagatgaat gggcagcctc tgccacgtga ccacggcttc cctgtgcgtg tggtggttcc
1201  tggagtggtg ggtgcccgcc atgtcaaatg gctgggcaga gtgagtgtgc agccagagga
1261  aagttacagc cactggcaac ggcgggatta caaggcttc tctccatctg tggactggga
1321  gactgtagat tttgactctg ctccatccat tcaggaactt cctgtccagt cggccatcac
1381  agagcccgg gatggagaga ctgtagaatc aggggaggtg accatcaagg gctatgcatg
1441  gagtggtggt ggcagggctg tgatccgggt ggatgtgtct ctggatgggg gcctaacctg
1501  gcaggtggct aagctggatg gagaggaaca gcgcccagg aaggcctggg catggcgtct
1561  gtggcagttg aaagcccctg tgccagctgg acaaaaggaa ctgaacattg tttgtaaggc
1621  tgtggatgat ggttacaatg tgcagccaga caccgtggcc ccaatctgga acctgcgagg
1681  tgttctcagc aatgcctggc atcgtgtcca tgtctatgtc tccccatgag catggaaagg
1741  agccacctcc accccttcc ccacccatta gcctcactgc ttcagaaaaa tctttcccac
1801  ctttcaactt cttggatcac aactctggcc ttcctaagcc atacccaagt acacatatag
1861  cacatttcac ccaaggacct tccctctttg gacactatgt tacataccc tcttggcctt
1921  tgaacctgtg ccaggaagtg tgagctgtta cagcaagggg ctagaagtga aaaaagtaat
1981  tctggagaca agcactattt tctcttccta ccccacctcc atttctaatg cctactgcca
2041  tcaaggcctt gttttgcttt tcttttttgga ttgttcagag aaatgtgtgt ggcatgtgta
2101  agaaaagtgt atatactatc ttatactacc tctccaggtt gccagagagt tgcgaggaga
2161  gcaaggggca caaccgtctc cctttatagt tctactttc taataaatag tctgtttaag
2221  atcataaaaa aaaaaaaaa aaaaaaaaaa aaaaaaaaaa aaaaaaaaaa aaaaaaaaaa
2281  aaaaaaaaaa aaaaaaaaa aaaaaaaaa aaaaaaaaa aaaaaaaa
```

US 8,575,120 B2

GENETIC ALTERATIONS ON CHROMOSOME 12 AND METHODS OF USE THEREOF FOR THE DIAGNOSIS AND TREATMENT OF TYPE 1 DIABETES

The present application is §371 application of PCT/US2008/056864 filed Mar. 13, 2008 which claims priority to U.S. Provisional Application Nos. 60/894,649 filed Mar. 13, 2007, 60/910,019 filed Apr. 4, 2007 and 60/940,274 filed May 25, 2007, the entire disclosure of each being incorporated by reference herein.

FIELD OF THE INVENTION

This invention relates to the fields of glucose metabolism, genetics and pathology associated with diabetes, particularly type I diabetes. More specifically, the invention provides a panel of genes containing single nucleotide polymorphisms which had heretofore not been associated with this disease. Methods and kits for using the sequences so identified for diagnostic and therapeutic treatment purposes are also provided, as are therapeutic compositions for management of diabetes.

BACKGROUND OF THE INVENTION

Several publications and patent documents are cited throughout the specification in order to describe the state of the art to which this invention pertains. Each of these citations is incorporated herein by reference as though set forth in full.

Type I diabetes (T1D) results from the autoimmune destruction of pancreatic beta cells, a process believed to be strongly influenced by multiple genes and environmental factors. The incidence of T1D has been increasing in Western countries and has more than doubled in the United States over the past 30 years. The disease shows a strong familial component, with first-degree relatives of cases being at 15 times greater risk of T1D than a randomly selected member of the general population and monozygotic twins being concordant for T1D at a frequency of approximately 50%. However, while the genetic evidence is strong, the latter data suggests that an interplay with environmental factors also plays a key role in influencing T1D outcome.

The familial clustering of T1D is influenced by multiple genes. Variation in four loci has already been established to account for a significant proportion of the familial aggregation of T1D. These include the major histocompatibility complex (MHC) region on 6p21 (including the HLA-DRB1, -DQA1 and -DRQ1 genes[1]); the insulin/insulin-like growth factor 2 gene complex (INS-IGF2) on 11p15[2-4], the protein tyrosine phosphatase-22 (PTPN22) gene on 1p13[5,6] and the gene encoding cytotoxic T-lymphocyte-associated protein 4 (CTLA4) on 2q31[7,8]. The interleukin-2 receptor alpha (CD25) locus on 10p15[9] has also been implicated in the pathogenesis of T1D but remains to be replicated by independent studies. In addition, spontaneous mouse model studies of T1D have implicated numerous other regions that have been confirmed in replication studies[10]. Several other loci have also been implicated in human association studies with T1D but the effects of these implicated genes remain controversial and are subject to confirmation in independent studies utilizing sufficient sample sizes. Together, these studies suggest that many more T1D susceptibility genes remain to be discovered. It is also clear that there are differences in genetic susceptibility to T1D between populations. An explanation for this variation may be related to differing frequencies of T1D causative and protective variants between different populations and ethnic groups, a hypothesis that needs to be addressed in multi-center, multi-national studies that are truly trans-continental.

SUMMARY OF THE INVENTION

In accordance with the present invention, T1D-associated SNPs have been identified which are indicative of an increased or reduced risk of developing T1D. Thus, in one aspect, nucleic acids comprising at least one genetic alteration identified in Tables 1-3 are provided. Such nucleic acids and the proteins encoded thereby have utility in the diagnosis and management of type 1 diabetes (T1D).

In another aspect of the invention, methods for assessing susceptibility for developing T1D are provided. An exemplary method entails providing a target nucleic acid from a patient sample, said target nucleic acid having a predetermined sequence in the normal population, and assessing said target nucleic acid for the presence of a single nucleotide polymorphism which is indicative of an increased or decreased risk of developing T1D. Such genetic alterations include, without limitation, inversion, deletion, duplication, and insertion of at least one nucleotide in said sequence.

Preferably, the genetic alteration is a single nucleotide polymorphism at the 12q13 region of chromosome 12, said SNP being associated with increased risk of developing T1D. Preferably, the SNP is present on locus 18 and comprises an allele selected from the group consisting of G of rs10876864, C of rs1701704 and G of rs773107. These aforementioned SNPs are present on a region of chromosome 12q13 harboring the RAB5B, CDK2, SUOX, IKZF4, RPS26 and ERBB3 genes.

The methods of the invention also include the detection of any of the T1D associated genetic alterations comprising the single nucleotide polymorphisms set forth in Tables 1-3 for the diagnosis of T1D. Kits and microarrays for practicing the foregoing methods are also provided.

In yet another embodiment, a method of managing T1D is provided which entails administering a therapeutic agent to a patient in need thereof. The therapeutic agent can be a small molecule, an antibody, a protein, an oligonucleotide, or a siRNA molecule.

In another aspect of the invention, a method for identifying agents that bind and/or modulate RPS26 functional activity is provided, as well as pharmaceutical compositions comprising said agent in a biologically acceptable carrier.

BRIEF DESCRIPTION OF THE DRAWINGS

FIG. 2. RPS26 sequence located on chromosome 12q13. Both the nucleic acid sequence (SEQ ID NO: 1) in panel A and protein sequence (SEQ ID NO: 2) in panel B of RPS26 corresponding to GenBank Accession number NM_001029 are shown. This sequence is the basis of the candidate siRNA molecules in Table 9, SEQ ID NOs: 1913-2002.

FIG. 3. CDK2 nucleic acid sequences used to design candidate siRNA molecules. Panel A shows GenBank Accession number NM_052827 (SEQ ID NO: 3) which corresponds to Table 5, SEQ ID NOs: 12-251, and panel B shows GenBank Accession number NM_001798 (SEQ ID NO: 4) corresponding to SEQ ID NOs: 252-488 of Table 5.

FIG. 4. ERBB3 nucleic acid sequence used to design candidate siRNA molecules. Panel A shows GenBank Accession number NM_001005915 (SEQ ID NO: 5) which corresponds with SEQ ID NOs: 489-568 of Table 6, and panel B shows GenBank Accession number NM_001982 (SEQ ID NO: 6) which corresponds with SEQ ID NOs: 569-1120 of Table 6.

FIG. 5. IKZF4 nucleic acid sequence used to design candidate siRNA molecules. The figure shows GenBank Accession number NM_022465 (SEQ ID NO: 7) which corresponds with SEQ ID NOs: 1121-1592 of Table 7.

FIG. 6. RAB5B nucleic acid sequence used to design candidate siRNA molecules. The figure shows GenBank Accession number NM_002868 (SEQ ID NO: 8) which corresponds with SEQ ID NO: 1593-1912 of Table 8.

FIG. 7 SUOX nucleic acid sequences used to design candidate siRNA molecules. Panel A shows GenBank Accession number NM_000456 (SEQ ID NO: 9) which corresponds with SEQ ID NOs: 2003-2204 of Table 10, panel B shows GenBank Accession number NM_001032386 (SEQ ID NO: 10) which corresponds with SEQ ID NOs: 2205-2394 of Table 10, and panel C shows GenBank Accession number NM_001032387 (SEQ ID NO: 11) which corresponds with SEQ ID NOs: 2395-2576 of Table 10.

DETAILED DESCRIPTION OF THE INVENTION

Figure 1:
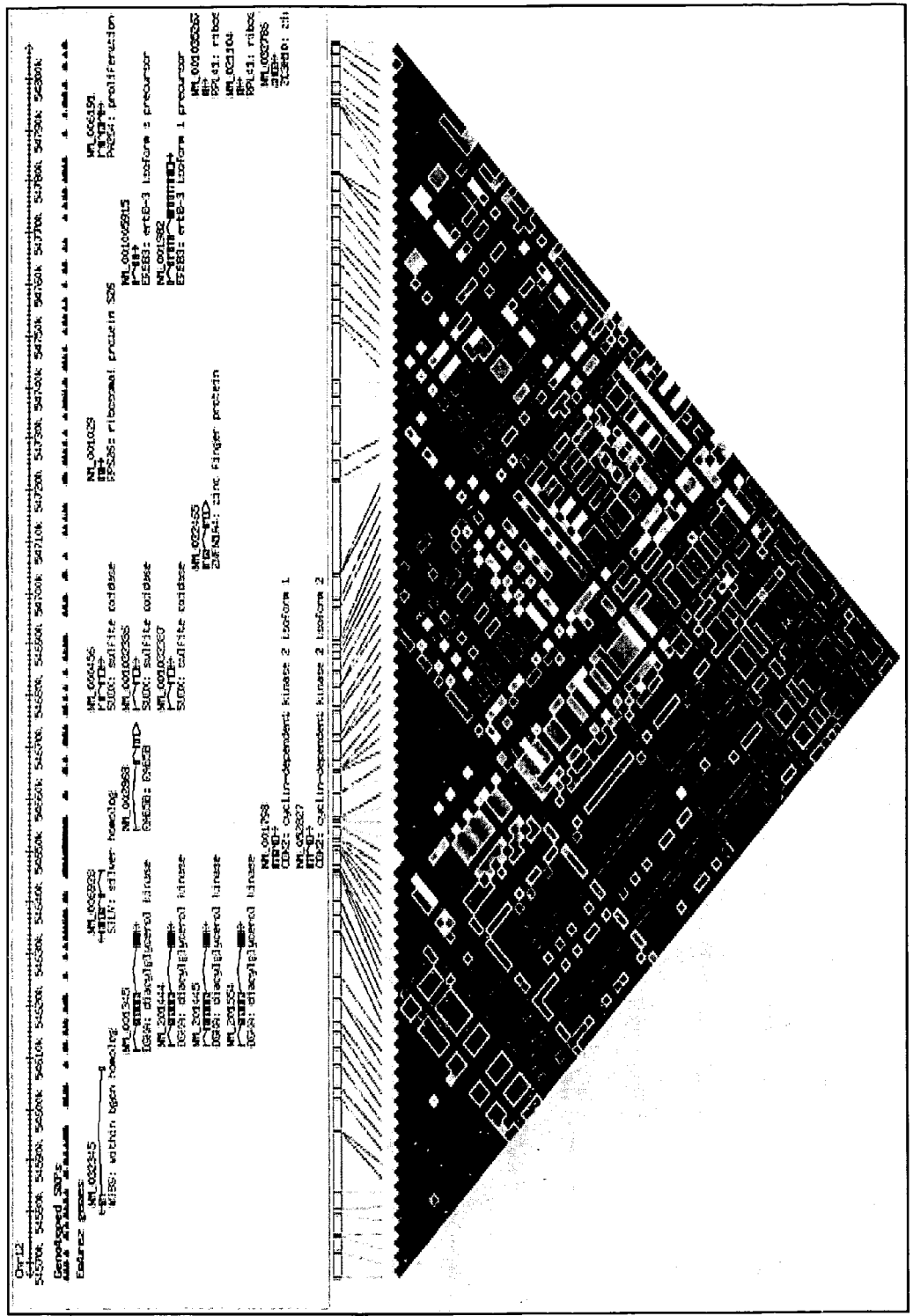
FIG. 1. Pairwise linkage disequilibrium diagram of the locus on 12q13. This 'gold plot' is derived from HapMap CEU data corresponding to a region spanning from 54567159 (rs12298127) to 54806642 (rs17118317) base pairs on chromosome 12 (Build 35); intensity of shading is proportional to D'. The relative genomic location of the genes is shown.

A number of genetic determinants of T1D have already been established through candidate gene studies, primarily with the major histocompatibility complex (MHC) but also with other loci. To identify novel genetic factors that confer risk of T1D, a genome-wide association (GWA) study in a large pediatric study cohort of Western European decent was performed. In addition to confirming previously identified loci, we also observed and replicated association to the 12q13 region of chromosome 12, with increased risk of developing T1D. Three common non-coding variants (G of rs10876864, C of rs1701704 and G of rs773107) in strong LD conferred risk for T1D. These SNPs are present on a region of chromosome 12q13 harboring the RAB5B, CDK2, SUOX, IKZF4, RPS26 and ERBB3 genes.

These results provide evidence for a novel genetic factor that contributes substantially to the pathogenesis of T1D, including a common variant conferring risk for developing disease, and thus providing a promising new T1D therapeutic and diagnostic target.

The following definitions are provided to facilitate an understanding of the present invention:

For purposes of the present invention, "a" or "an" entity refers to one or more of that entity; for example, "a cDNA" refers to one or more cDNA or at least one cDNA. As such, the terms "a" or "an," "one or more" and "at least one" can be used interchangeably herein. It is also noted that the terms "comprising," "including," and "having" can be used interchangeably. Furthermore, a compound "selected from the group consisting of" refers to one or more of the compounds in the list that follows, including mixtures (i.e. combinations) of two or more of the compounds. According to the present invention, an isolated, or biologically pure molecule is a compound that has been removed from its natural milieu. As such, "isolated" and "biologically pure" do not necessarily reflect the extent to which the compound has been purified. An isolated compound of the present invention can be obtained from its natural source, can be produced using laboratory synthetic techniques or can be produced by any such chemical synthetic route.

A "single nucleotide polymorphism (SNP)" refers to a change in which a single base in the DNA differs from the usual base at that position. These single base changes are called SNPs or "snips." Millions of SNP's have been cataloged in the human genome. Some SNPs such that which causes sickle cell are responsible for disease. Other SNPs are normal variations in the genome.

The term "genetic alteration" as used herein refers to a change from the wild-type or reference sequence of one or more nucleic acid molecules. Genetic alterations include without limitation, base pair substitutions, additions and deletions of at least one nucleotide from a nucleic acid molecule of known sequence.

The phrase "Type 1 diabetes (T1D)" refers to a chronic (lifelong) disease that occurs when the pancreas produces too little insulin to regulate blood sugar levels appropriately. T1D, often called juvenile or insulin-dependent diabetes results from altered metabolism of carbohydrates (including sugars such as glucose), proteins, and fats. In type 1 diabetes, the beta cells of the pancreas produce little or no insulin, the hormone that allows glucose to enter body cells. Once glucose enters a cell, it is used as fuel. Without adequate insulin, glucose builds up in the bloodstream instead of going into the cells. The body is unable to use this glucose for energy despite high levels in the bloodstream, leading to increased hunger. In addition, the high levels of glucose in the blood cause the patient to urinate more, which in turn causes excessive thirst. Within 5 to 10 years after diagnosis, the insulin-producing beta cells of the pancreas are completely destroyed, and no more insulin is produced.

"T1D-associated SNP or specific marker" is a SNP or marker which is associated with an increased or decreased risk of developing T1D not found normal patients who do not have this disease. Such markers may include but are not limited to nucleic acids, proteins encoded thereby, or other small molecules. Type 1 diabetes can occur at any age, but it usually starts in people younger than 30. Symptoms are usually severe and occur rapidly. The exact cause of type 1 diabetes is not known. Type 1 diabetes accounts for 3% of all new cases of diabetes each year. There is 1 new case per every 7,000 children per year. New cases are less common among adults older than 20.

The term "solid matrix" as used herein refers to any format, such as beads, microparticles, a microarray, the surface of a microtitration well or a test tube, a dipstick or a filter. The material of the matrix may be polystyrene, cellulose, latex, nitrocellulose, nylon, polyacrylamide, dextran or agarose. "Sample" or "patient sample" or "biological sample" generally refers to a sample which may be tested for a particular molecule, preferably an T1D specific marker molecule, such as a marker shown in the tables provided below. Samples may include but are not limited to cells, body fluids, including blood, serum, plasma, urine, saliva, tears, pleural fluid and the like.

The phrase "consisting essentially of" when referring to a particular nucleotide or amino acid means a sequence having the properties of a given SEQ ID NO. For example, when used in reference to an amino acid sequence, the phrase includes the sequence per se and molecular modifications that would not affect the functional and novel characteristics of the sequence.

"Target nucleic acid" as used herein refers to a previously defined region of a nucleic acid present in a complex nucleic acid mixture wherein the defined wild-type region contains at least one known nucleotide variation which may or may not be associated with T1D. The nucleic acid molecule may be isolated from a natural source by cDNA cloning or subtractive hybridization or synthesized manually. The nucleic acid molecule may be synthesized manually by the triester synthetic method or by using an automated DNA synthesizer.

With regard to nucleic acids used in the invention, the term "isolated nucleic acid" is sometimes employed. This term, when applied to DNA, refers to a DNA molecule that is separated from sequences with which it is immediately contiguous (in the 5' and 3' directions) in the naturally occurring genome of the organism from which it was derived. For example, the "isolated nucleic acid" may comprise a DNA molecule inserted into a vector, such as a plasmid or virus vector, or integrated into the genomic DNA of a prokaryote or eukaryote. An "isolated nucleic acid molecule" may also comprise a cDNA molecule. An isolated nucleic acid molecule inserted into a vector is also sometimes referred to herein as a recombinant nucleic acid molecule.

With respect to RNA molecules, the term "isolated nucleic acid" primarily refers to an RNA molecule encoded by an isolated DNA molecule as defined above. Alternatively, the term may refer to an RNA molecule that has been sufficiently separated from RNA molecules with which it would be associated in its natural state (i.e., in cells or tissues), such that it exists in a "substantially pure" form. By the use of the term "enriched" in reference to nucleic acid it is meant that the specific DNA or RNA sequence constitutes a significantly higher fraction (2-5 fold) of the total DNA or RNA present in the cells or solution of interest than in normal cells or in the cells from which the sequence was taken. This could be caused by a person by preferential reduction in the amount of other DNA or RNA present, or by a preferential increase in the amount of the specific DNA or RNA sequence, or by a combination of the two. However, it should be noted that "enriched" does not imply that there are no other DNA or RNA sequences present, just that the relative amount of the sequence of interest has been significantly increased.

It is also advantageous for some purposes that a nucleotide sequence be in purified form. The term "purified" in reference to nucleic acid does not require absolute purity (such as a homogeneous preparation); instead, it represents an indication that the sequence is relatively purer than in the natural environment (compared to the natural level, this level should be at least 2-5 fold greater, e.g., in terms of mg/ml). Individual clones isolated from a cDNA library may be purified to electrophoretic homogeneity. The claimed DNA molecules obtained from these clones can be obtained directly from total DNA or from total RNA. The cDNA clones are not naturally occurring, but rather are preferably obtained via manipulation of a partially purified naturally occurring substance (messenger RNA). The construction of a cDNA library from mRNA involves the creation of a synthetic substance (cDNA) and pure individual cDNA clones can be isolated from the synthetic library by clonal selection of the cells carrying the cDNA library. Thus, the process which includes the construction of a cDNA library from mRNA and isolation of distinct cDNA clones yields an approximately $10^{-6}$-fold purification of the native message. Thus, purification of at least one order of magnitude, preferably two or three orders, and more preferably four or five orders of magnitude is expressly contemplated. Thus, the term "substantially pure" refers to a preparation comprising at least 50-60% by weight the compound of interest (e.g., nucleic acid, oligonucleotide, etc.). More preferably, the preparation comprises at least 75% by weight, and most preferably 90-99% by weight, the compound of interest. Purity is measured by methods appropriate for the compound of interest.

The term "complementary" describes two nucleotides that can form multiple favorable interactions with one another. For example, adenine is complementary to thymine as they can form two hydrogen bonds. Similarly, guanine and cytosine are complementary since they can form three hydrogen bonds. Thus if a nucleic acid sequence contains the following sequence of bases, thymine, adenine, guanine and cytosine, a "complement" of this nucleic acid molecule would be a molecule containing adenine in the place of thymine, thymine in the place of adenine, cytosine in the place of guanine, and guanine in the place of cytosine. Because the complement can contain a nucleic acid sequence that forms optimal interactions with the parent nucleic acid molecule, such a complement can bind with high affinity to its parent molecule.

With respect to single stranded nucleic acids, particularly oligonucleotides, the term "specifically hybridizing" refers to the association between two single-stranded nucleotide molecules of sufficiently complementary sequence to permit such hybridization under pre-determined conditions generally used in the art (sometimes termed "substantially complementary"). In particular, the term refers to hybridization of an oligonucleotide with a substantially complementary sequence contained within a single-stranded DNA or RNA molecule of the invention, to the substantial exclusion of hybridization of the oligonucleotide with single-stranded nucleic acids of non-complementary sequence. For example, specific hybridization can refer to a sequence which hybridizes to any T1D specific marker gene or nucleic acid, but does not hybridize to other human nucleotides. Also polynucleotide which "specifically hybridizes" may hybridize only to a T1D specific marker, such a T1D-specific marker shown in Tables 1-3. Appropriate conditions enabling specific hybridization of single stranded nucleic acid molecules of varying complementarity are well known in the art. For instance, one common formula for calculating the stringency conditions required to achieve hybridization between nucleic acid molecules of a specified sequence homology is set forth below (Sambrook et al., *Molecular Cloning*, Cold Spring Harbor Laboratory (1989):

$T_m = 81.5°\,C. + 16.6\,\text{Log}\,[\text{Na+}] + 0.41(\%\,G+C) - 0.63(\%\,\text{formamide}) - 600/\#\text{bp in duplex}$ As an illustration of the above formula, using [Na+]= [0.368] and 50% formamide, with GC content of 42% and an average probe size of 200 bases, the $T_m$ is 57° C. The $T_m$ of a DNA duplex decreases by 1-1.5° C. with every 1% decrease in homology. Thus, targets with greater than about 75% sequence identity would be observed using a hybridization temperature of 42° C.

The stringency of the hybridization and wash depend primarily on the salt concentration and temperature of the solutions. In general, to maximize the rate of annealing of the probe with its target, the hybridization is usually carried out at salt and temperature conditions that are 20-25° C. below the calculated $T_m$ of the hybrid. Wash conditions should be as stringent as possible for the degree of identity of the probe for the target. In general, wash conditions are selected to be approximately 12-20° C. below the $T_m$ of the hybrid. In regards to the nucleic acids of the current invention, a moderate stringency hybridization is defined as hybridization in 6×SSC, 5×Denhardt's solution, 0.5% SDS and 100 µg/ml denatured salmon sperm DNA at 42° C., and washed in 2×SSC and 0.5% SDS at 55° C. for 15 minutes. A high stringency hybridization is defined as hybridization in 6×SSC, 5×Denhardt's solution, 0.5% SDS and 100 µg/ml denatured salmon sperm DNA at 42° C., and washed in 1×SSC and 0.5% SDS at 65° C. for 15 minutes. A very high stringency hybridization is defined as hybridization in 6×SSC, 5×Denhardt's solution, 0.5% SDS and 100 µg/ml denatured salmon sperm DNA at 42° C., and washed in 0.1× SSC and 0.5% SDS at 65° C. for 15 minutes.

The term "oligonucleotide" or "oligo" as used herein means a short sequence of DNA or DNA derivatives typically 8 to 35 nucleotides in length, primers, or probes. An oligonucleotide can be derived synthetically, by cloning or by amplification. An oligo is defined as a nucleic acid molecule comprised of two or more ribo- or deoxyribonucleotides, preferably more than three. The exact size of the oligonucleotide will depend on various factors and on the particular application and use of the oligonucleotide. The term "derivative" is intended to include any of the above described variants when comprising an additional chemical moiety not normally a part of these molecules. These chemical moieties can have varying purposes including, improving solubility, absorption, biological half life, decreasing toxicity and eliminating or decreasing undesirable side effects.

The term "probe" as used herein refers to an oligonucleotide, polynucleotide or nucleic acid, either RNA or DNA, whether occurring naturally as in a purified restriction enzyme digest or produced synthetically, which is capable of annealing with or specifically hybridizing to a nucleic acid with sequences complementary to the probe. A probe may be either single-stranded or double-stranded. The exact length of the probe will depend upon many factors, including temperature, source of probe and use of the method. For example, for diagnostic applications, depending on the complexity of the target sequence, the oligonucleotide probe typically contains 15-25 or more nucleotides, although it may contain fewer nucleotides. The probes herein are selected to be complementary to different strands of a particular target nucleic acid sequence. This means that the probes must be sufficiently complementary so as to be able to "specifically hybridize" or anneal with their respective target strands under a set of pre-determined conditions. Therefore, the probe sequence need not reflect the exact complementary sequence of the target. For example, a non-complementary nucleotide fragment may be attached to the 5' or 3' end of the probe, with the remainder of the probe sequence being complementary to the target strand. Alternatively, non-complementary bases or longer sequences can be interspersed into the probe, provided that the probe sequence has sufficient complementarity with the sequence of the target nucleic acid to anneal therewith specifically.

The term "primer" as used herein refers to an oligonucleotide, either RNA or DNA, either single-stranded or double-stranded, either derived from a biological system, generated by restriction enzyme digestion, or produced synthetically which, when placed in the proper environment, is able to functionally act as an initiator of template-dependent nucleic acid synthesis. When presented with an appropriate nucleic acid template, suitable nucleoside triphosphate precursors of nucleic acids, a polymerase enzyme, suitable cofactors and conditions such as a suitable temperature and pH, the primer may be extended at its 3' terminus by the addition of nucleotides by the action of a polymerase or similar activity to yield a primer extension product. The primer may vary in length depending on the particular conditions and requirement of the application. For example, in diagnostic applications, the oligonucleotide primer is typically 15-25 or more nucleotides in length. The primer must be of sufficient complementarity to the desired template to prime the synthesis of the desired extension product, that is, to be able anneal with the desired template strand in a manner sufficient to provide the 3' hydroxyl moiety of the primer in appropriate juxtaposition for use in the initiation of synthesis by a polymerase or similar enzyme. It is not required that the primer sequence represent an exact complement of the desired template. For example, a non-complementary nucleotide sequence may be attached to the 5' end of an otherwise complementary primer. Alternatively, non-complementary bases may be interspersed within the oligonucleotide primer sequence, provided that the primer sequence has sufficient complementarity with the sequence of the desired template strand to functionally provide a template-primer complex for the synthesis of the extension product.

Polymerase chain reaction (PCR) has been described in U.S. Pat. Nos. 4,683,195, 4,800,195, and 4,965,188, the entire disclosures of which are incorporated by reference herein.

An "siRNA" refers to a molecule involved in the RNA interference process for a sequence-specific post-transcriptional gene silencing or gene knockdown by providing small interfering RNAs (siRNAs) that has homology with the sequence of the targeted gene. Small interfering RNAs (siRNAs) can be synthesized in vitro or generated by ribonuclease III cleavage from longer dsRNA and are the mediators of sequence-specific mRNA degradation. Preferably, the siRNA of the invention are chemically synthesized using appropriately protected ribonucleoside phosphoramidites and a conventional DNA/RNA synthesizer. The siRNA can be synthesized as two separate, complementary RNA molecules, or as a single RNA molecule with two complementary regions. Commercial suppliers of synthetic RNA molecules or synthesis reagents include Applied Biosystems (Foster City, Calif., USA), Proligo (Hamburg, Germany), Dharmacon Research (Lafayette, Colo., USA), Pierce Chemical (part of Perbio Science, Rockford, Ill., USA), Glen Research (Sterling, Va., USA), ChemGenes (Ashland, Mass., USA) and Cruachem (Glasgow, UK). Specific siRNA constructs for inhibiting the mRNA of one of the six genes on 12q13, or SNP-containing genes may be between 15-35 nucleotides in length, and more typically about 21 nucleotides in length. Specific siRNA constructs for inhibiting RPS26 mRNA may be between 15-35 nucleotides in length, and more typically about 21 nucleotides in length. A list of candidate siRNAs directed to CDK2 ERBB3, IKZF4, RAB5B, RPS26, and SUOX are provided in Tables 5-10 respectively.

The term "vector" relates to a single or double stranded circular nucleic acid molecule that can be infected, transfected or transformed into cells and replicate independently or within the host cell genome. A circular double stranded nucleic acid molecule can be cut and thereby linearized upon treatment with restriction enzymes. An assortment of vectors, restriction enzymes, and the knowledge of the nucleotide sequences that are targeted by restriction enzymes are readily available to those skilled in the art, and include any replicon, such as a plasmid, cosmid, bacmid, phage or virus, to which another genetic sequence or element (either DNA or RNA) may be attached so as to bring about the replication of the attached sequence or element. A nucleic acid molecule of the invention can be inserted into a vector by cutting the vector with restriction enzymes and ligating the two pieces together.

Many techniques are available to those skilled in the art to facilitate transformation, transfection, or transduction of the expression construct into a prokaryotic or eukaryotic organism. The terms "transformation", "transfection", and "transduction" refer to methods of inserting a nucleic acid and/or expression construct into a cell or host organism. These methods involve a variety of techniques, such as treating the cells with high concentrations of salt, an electric field, or detergent, to render the host cell outer membrane or wall permeable to nucleic acid molecules of interest, microinjection, peptide-tethering, PEG-fusion, and the like.

The term "promoter element" describes a nucleotide sequence that is incorporated into a vector that, once inside an appropriate cell, can facilitate transcription factor and/or polymerase binding and subsequent transcription of portions of the vector DNA into mRNA. In one embodiment, the promoter element of the present invention precedes the 5' end of the T1D specific marker nucleic acid molecule such that the latter is transcribed into mRNA. Host cell machinery then translates mRNA into a polypeptide.

Those skilled in the art will recognize that a nucleic acid vector can contain nucleic acid elements other than the promoter element and the T1D specific marker gene nucleic acid molecule. These other nucleic acid elements include, but are not limited to, origins of replication, ribosomal binding sites, nucleic acid sequences encoding drug resistance enzymes or amino acid metabolic enzymes, and nucleic acid sequences encoding secretion signals, localization signals, or signals useful for polypeptide purification.

A "replicon" is any genetic element, for example, a plasmid, cosmid, bacmid, plastid, phage or virus that is capable of replication largely under its own control. A replicon may be either RNA or DNA and may be single or double stranded.

An "expression operon" refers to a nucleic acid segment that may possess transcriptional and translational control sequences, such as promoters, enhancers, translational start signals (e.g., ATG or AUG codons), polyadenylation signals, terminators, and the like, and which facilitate the expression of a polypeptide coding sequence in a host cell or organism.

As used herein, the terms "reporter," "reporter system", "reporter gene," or "reporter gene product" shall mean an operative genetic system in which a nucleic acid comprises a gene that encodes a product that when expressed produces a reporter signal that is a readily measurable, e.g., by biological assay, immunoassay, radio immunoassay, or by colorimetric, fluorogenic, chemiluminescent or other methods. The nucleic acid may be either RNA or DNA, linear or circular, single or double stranded, antisense or sense polarity, and is operatively linked to the necessary control elements for the expression of the reporter gene product. The required control elements will vary according to the nature of the reporter system and whether the reporter gene is in the form of DNA or RNA, but may include, but not be limited to, such elements as promoters, enhancers, translational control sequences, poly A addition signals, transcriptional termination signals and the like.

The introduced nucleic acid may or may not be integrated (covalently linked) into nucleic acid of the recipient cell or organism. In bacterial, yeast, plant and mammalian cells, for example, the introduced nucleic acid may be maintained as an episomal element or independent replicon such as a plasmid. Alternatively, the introduced nucleic acid may become integrated into the nucleic acid of the recipient cell or organism and be stably maintained in that cell or organism and further passed on or inherited to progeny cells or organisms of the recipient cell or organism. Finally, the introduced nucleic acid may exist in the recipient cell or host organism only transiently.

The term "selectable marker gene" refers to a gene that when expressed confers a selectable phenotype, such as antibiotic resistance, on a transformed cell.

The term "operably linked" means that the regulatory sequences necessary for expression of the coding sequence are placed in the DNA molecule in the appropriate positions relative to the coding sequence so as to effect expression of the coding sequence. This same definition is sometimes applied to the arrangement of transcription units and other transcription control elements (e.g. enhancers) in an expression vector.

The terms "recombinant organism," or "transgenic organism" refer to organisms which have a new combination of genes or nucleic acid molecules. A new combination of genes or nucleic acid molecules can be introduced into an organism using a wide array of nucleic acid manipulation techniques available to those skilled in the art. The term "organism" relates to any living being comprised of a least one cell. An organism can be as simple as one eukaryotic cell or as complex as a mammal. Therefore, the phrase "a recombinant organism" encompasses a recombinant cell, as well as eukaryotic and prokaryotic organism.

The term "isolated protein" or "isolated and purified protein" is sometimes used herein. This term refers primarily to a protein produced by expression of an isolated nucleic acid molecule of the invention. Alternatively, this term may refer to a protein that has been sufficiently separated from other proteins with which it would naturally be associated, so as to exist in "substantially pure" form. "Isolated" is not meant to exclude artificial or synthetic mixtures with other compounds or materials, or the presence of impurities that do not interfere with the fundamental activity, and that may be present, for example, due to incomplete purification, addition of stabilizers, or compounding into, for example, immunogenic preparations or pharmaceutically acceptable preparations.

A "specific binding pair" comprises a specific binding member (sbm) and a binding partner (bp) which have a particular specificity for each other and which in normal conditions bind to each other in preference to other molecules. Examples of specific binding pairs are antigens and antibodies, ligands and receptors and complementary nucleotide sequences. The skilled person is aware of many other examples. Further, the term "specific binding pair" is also applicable where either or both of the specific binding member and the binding partner comprise a part of a large molecule. In embodiments in which the specific binding pair comprises nucleic acid sequences, they will be of a length to hybridize to each other under conditions of the assay, preferably greater than 10 nucleotides long, more preferably greater than 15 or 20 nucleotides long. "Sample" or "patient sample" or "biological sample" generally refers to a sample which may be tested for a particular molecule, preferably a T1D specific marker molecule, such as a marker shown in Tables 1-3. Samples may include but are not limited to cells, body fluids, including blood, serum, plasma, urine, saliva, tears, pleural fluid and the like.

The terms "agent" and "test compound" are used interchangeably herein and denote a chemical compound, a mixture of chemical compounds, a biological macromolecule, or an extract made from biological materials such as bacteria, plants, fungi, or animal (particularly mammalian) cells or tissues. Biological macromolecules include siRNA, shRNA, antisense oligonucleotides, small molecules, antibodies, peptides, peptide/DNA complexes, and any nucleic acid based molecule, for example an oligo, which exhibits the capacity to modulate the activity of the SNP containing nucleic acids described herein or their encoded proteins. Agents are evaluated for potential biological activity by inclusion in screening assays described herein below.

The term "modulate" as used herein refers increasing or decreasing. For example, the term modulate refers to the ability of a compound or test agent to interfere with signaling or activity of a gene or protein of the present invention. Therefore, modulating the signaling mediated by RPS26 means that an agent or compound inhibits or enhances the activity of the proteins encoded by the gene. This includes altering the activity of natural killer cells, and preventing autoimmune beta cell destruction.

Methods of Using T1D-Associated SNPS for T1D Detection Assays

T1D SNP containing nucleic acids, including but not limited to those listed in Tables 1-3, may be used for a variety of purposes in accordance with the present invention. T1D-associated SNP containing DNA, RNA, or fragments thereof may be used as probes to detect the presence of and/or expression of T1D specific markers. Methods in which T1D specific marker nucleic acids may be utilized as probes for such assays include, but are not limited to: (1) in situ hybridization; (2) Southern hybridization (3) northern hybridization; and (4) assorted amplification reactions such as polymerase chain reactions (PCR).

Further, assays for detecting T1D-associated SNPs may be conducted on any type of biological sample, including but not limited to body fluids (including blood, urine, serum, gastric lavage), any type of cell (such as white blood cells, mononuclear cells) or body tissue.

From the foregoing discussion, it can be seen that T1D associated SNP containing nucleic acids, vectors expressing the same, T1D SNP containing marker proteins and anti-T1D specific marker antibodies of the invention can be used to detect T1D associated SNPs in body tissue, cells, or fluid, and alter T1D SNP containing marker protein expression for purposes of assessing the genetic and protein interactions involved in T1D.

In most embodiments for screening for T1D-associated SNPs, the T1D-associated SNP containing nucleic acid in the sample will initially be amplified, e.g. using PCR, to increase the amount of the template as compared to other sequences present in the sample. This allows the target sequences to be detected with a high degree of sensitivity if they are present in the sample. This initial step may be avoided by using highly sensitive array techniques that are becoming increasingly important in the art.

Alternatively, new detection technologies can overcome this limitation and enable analysis of small samples containing as little as 1 µg of total RNA. Using Resonance Light Scattering (RLS) technology, as opposed to traditional fluorescence techniques, multiple reads can detect low quantities of mRNAs using biotin labeled hybridized targets and anti-biotin antibodies. Another alternative to PCR amplification involves planar wave guide technology (PWG) to increase signal-to-noise ratios and reduce background interference. Both techniques are commercially available from Qiagen Inc. (USA).

Thus, any of the aforementioned techniques may be used to detect or quantify T1D-associated SNP marker expression and accordingly, detect patient susceptibility for developing T1D.

Kits and Articles of Manufacture

Any of the aforementioned products can be incorporated into a kit which may contain an T1D-associated SNP specific marker polynucleotide or one or more such markers immobilized on a Gene Chip, an oligonucleotide, a polypeptide, a peptide, an antibody, a label, marker, or reporter, a pharmaceutically acceptable carrier, a physiologically acceptable carrier, instructions for use, a container, a vessel for administration, an assay substrate, or any combination thereof.

Methods of Using T1D-Associated SNPS for Development of Therapeutic Agents

Since the SNPs identified herein have been associated with the etiology of T1D, methods for identifying agents that modulate the activity of the genes and their encoded products containing such SNPs should result in the generation of efficacious therapeutic agents for the treatment of a variety of disorders associated with this condition.

Chromosome 12 contains regions which provide suitable targets for the rational design of therapeutic agents which modulate their activity. Small peptide molecules corresponding to these regions may be used to advantage in the design of therapeutic agents which effectively modulate the activity of the encoded proteins.

Molecular modeling should facilitate the identification of specific organic molecules with capacity to bind to the active site of the proteins encoded by the SNP containing nucleic acids based on conformation or key amino acid residues required for function. A combinatorial chemistry approach will be used to identify molecules with greatest activity and then iterations of these molecules will be developed for further cycles of screening.

The polypeptides or fragments employed in drug screening assays may either be free in solution, affixed to a solid support or within a cell. One method of drug screening utilizes eukaryotic or prokaryotic host cells which are stably transformed with recombinant polynucleotides expressing the polypeptide or fragment, preferably in competitive binding assays. Such cells, either in viable or fixed form, can be used for standard binding assays. One may determine, for example, formation of complexes between the polypeptide or fragment and the agent being tested, or examine the degree to which the formation of a complex between the polypeptide or fragment and a known substrate is interfered with by the agent being tested.

Another technique for drug screening provides high throughput screening for compounds having suitable binding affinity for the encoded polypeptides and is described in detail in Geysen, PCT published application WO 84/03564, published on Sep. 13, 1984. Briefly stated, large numbers of different, small peptide test compounds, such as those described above, are synthesized on a solid substrate, such as plastic pins or some other surface. The peptide test compounds are reacted with the target polypeptide and washed. Bound polypeptide is then detected by methods well known in the art.

A further technique for drug screening involves the use of host eukaryotic cell lines or cells (such as described above) which have a nonfunctional or altered T1D associated gene. These host cell lines or cells are defective at the polypeptide level. The host cell lines or cells are grown in the presence of drug compound. The rate of cellular metabolism of the host cells is measured to determine if the compound is capable of regulating cellular metabolism in the defective cells. Host cells contemplated for use in the present invention include but are not limited to bacterial cells, fungal cells, insect cells, mammalian cells, and plant cells. The T1D-associated SNP encoding DNA molecules may be introduced singly into such host cells or in combination to assess the phenotype of cells conferred by such expression. Methods for introducing DNA molecules are also well known to those of ordinary skill in the art. Such methods are set forth in Ausubel et al. eds., Current Protocols in Molecular Biology, John Wiley & Sons, NY, N.Y. 1995, the disclosure of which is incorporated by reference herein.

Cells and cell lines suitable for studying the effects of the SNP encoding nucleic acids on glucose metabolism and methods of use thereof for drug discovery are provided. Such cells and cell lines will be transfected with the SNP encoding nucleic acids described herein and the effects on glucagon secretion, insulin secretion and/or beta cell apoptosis can be determined. Such cells and cell lines will also be contacted with the siRNA molecules provided herein to assess the effects thereof on glucagon secretion, insulin secretion and/or beta cell apoptosis. The siRNA molecules will be tested alone and in combination of 2, 3, 4, and 5 siRNAs to identify the most efficacious combination for down regulating the gene targets comprising the SNPs described herein (e.g., RAB5B, CDK2, SUOX, IKZF4, RPS26 and ERBB3). Cells suitable for these purposes include, without limitation, INS cells (ATCC CRL 11605), PC12 cells (ATCC CRL 1721), MIN6 cells, alpha-TC6 cells and INS-1 832/13 cells (Fernandez et al., J. of Proteome Res. (2007). 7:400-411). Pancreatic islet cells can be isolated and cultured as described in Joseph, J. et al., (J. Biol. Chem. (2004) 279:51049). Diao et al. (J. Biol. Chem. (2005) 280:33487-33496), provide methodology for assessing the effects of the SNP encoding nucleic acids and/or the siRNAs provided herein on glucagon secretion and insulin secretion. Park, J. et al. (J. of Bioch. and Mol. Biol. (2007) 40:1058-68) provide methodology for assessing the effect of these nucleic acid molecules on glucosamine induced beta cell apoptosis in pancreatic islet cells.

A wide variety of expression vectors are available that can be modified to express the novel DNA or RNA sequences of this invention. The specific vectors exemplified herein are merely illustrative, and are not intended to limit the scope of the invention. Expression methods are described by Sambrook et al. Molecular Cloning: A Laboratory Manual or Current Protocols in Molecular Biology 16.3-17.44 (1989). Expression methods in Saccharomyces are also described in Current Protocols in Molecular Biology (1989).

Suitable vectors for use in practicing the invention include prokaryotic vectors such as the pNH vectors (Stratagene Inc., 11099 N. Torrey Pines Rd., La Jolla, Calif. 92037), pET vectors (Novogen Inc., 565 Science Dr., Madison, Wis. 53711) and the pGEX vectors (Pharmacia LKB Biotechnology Inc., Piscataway, N.J. 08854). Examples of eukaryotic vectors useful in practicing the present invention include the vectors pRc/CMV, pRc/RSV, and pREP (Invitrogen, 11588 Sorrento Valley Rd., San Diego, Calif. 92121); pcDNA3.1/V5&H is (Invitrogen); baculovirus vectors such as pVL1392, pVL1393, or pAC360 (Invitrogen); and yeast vectors such as YRP17, YIPS, and YEP24 (New England Biolabs, Beverly, Mass.), as well as pRS403 and pRS413 Stratagene Inc.); Picchia vectors such as pHIL-D1 (Phillips Petroleum Co., Bartlesville, Okla. 74004); retroviral vectors such as PLNCX and pLPCX (Clontech); and adenoviral and adeno-associated viral vectors.

Promoters for use in expression vectors of this invention include promoters that are operable in prokaryotic or eukaryotic cells. Promoters that are operable in prokaryotic cells include lactose (lac) control elements, bacteriophage lambda (pL) control elements, arabinose control elements, tryptophan (trp) control elements, bacteriophage T7 control elements, and hybrids thereof. Promoters that are operable in eukaryotic cells include Epstein Barr virus promoters, adenovirus promoters, SV40 promoters, Rous Sarcoma Virus promoters, cytomegalovirus (CMV) promoters, baculovirus promoters such as AcMNPV polyhedrin promoter, Picchia promoters such as the alcohol oxidase promoter, and Saccharomyces promoters such as the gal4 inducible promoter and the PGK constitutive promoter, as well as neuronal-specific platelet-derived growth factor promoter (PDGF), the Thy-1 promoter, the hamster and mouse Prion promoter (MoPrP), and the Glial fibrillar acidic protein (GFAP) for the expression of transgenes in glial cells.

In addition, a vector of this invention may contain any one of a number of various markers facilitating the selection of a transformed host cell. Such markers include genes associated with temperature sensitivity, drug resistance, or enzymes associated with phenotypic characteristics of the host organisms.

Host cells expressing the T1D-associated SNPs of the present invention or functional fragments thereof provide a system in which to screen potential compounds or agents for the ability to modulate the development of T1D. Thus, in one embodiment, the nucleic acid molecules of the invention may be used to create recombinant cell lines for use in assays to identify agents which modulate aspects of lectin binding. Also provided herein are methods to screen for compounds capable of modulating the function of proteins encoded by the SNP containing nucleic acids described below.

Another approach entails the use of phage display libraries engineered to express fragment of the polypeptides encoded by the SNP containing nucleic acids on the phage surface. Such libraries are then contacted with a combinatorial chemical library under conditions wherein binding affinity between the expressed peptide and the components of the chemical library may be detected. U.S. Pat. Nos. 6,057,098 and 5,965,456 provide methods and apparatus for performing such assays.

The goal of rational drug design is to produce structural analogs of biologically active polypeptides of interest or of small molecules with which they interact (e.g., agonists, antagonists, inhibitors) in order to fashion drugs which are, for example, more active or stable forms of the polypeptide, or which, e.g., enhance or interfere with the function of a polypeptide in vivo. See, e.g., Hodgson, (1991) Bio/Technology 9:19-21. In one approach, discussed above, the three-dimensional structure of a protein of interest or, for example, of the protein-substrate complex, is solved by x-ray crystallography, by nuclear magnetic resonance, by computer modeling or most typically, by a combination of approaches. Less often, useful information regarding the structure of a polypeptide may be gained by modeling based on the structure of homologous proteins. An example of rational drug design is the development of HIV protease inhibitors (Erickson et al., (1990) Science 249:527-533). In addition, peptides may be analyzed by an alanine scan (Wells, (1991) Meth. Enzym. 202:390-411). In this technique, an amino acid residue is replaced by Ala, and its effect on the peptide's activity is determined. Each of the amino acid residues of the peptide is analyzed in this manner to determine the important regions of the peptide.

It is also possible to isolate a target-specific antibody, selected by a functional assay, and then to solve its crystal structure. In principle, this approach yields a pharmacophore upon which subsequent drug design can be based.

One can bypass protein crystallography altogether by generating anti-idiotypic antibodies (anti-ids) to a functional, pharmacologically active antibody. As a mirror image of a mirror image, the binding site of the anti-ids would be expected to be an analog of the original molecule. The anti-id could then be used to identify and isolate peptides from banks of chemically or biologically produced banks of peptides. Selected peptides would then act as the pharmacophore.

Thus, one may design drugs which have, e.g., improved polypeptide activity or stability or which act as inhibitors, agonists, antagonists, etc. of polypeptide activity. By virtue of the availability of SNP containing nucleic acid sequences described herein, sufficient amounts of the encoded polypeptide may be made available to perform such analytical studies as x-ray crystallography. In addition, the knowledge of the protein sequence provided herein will guide those employing computer modeling techniques in place of, or in addition to x-ray crystallography.

In another embodiment, the availability of T1D-associated SNP containing nucleic acids enables the production of strains of laboratory mice carrying the T1D-associated SNPs of the invention. Transgenic mice expressing the T1D-associated SNP of the invention provide a model system in which to examine the role of the protein encoded by the SNP containing nucleic acid in the development and progression towards T1D. Methods of introducing transgenes in laboratory mice are known to those of skill in the art. Three common methods include: (1) integration of retroviral vectors encoding the foreign gene of interest into an early embryo; (2) injection of DNA into the pronucleus of a newly fertilized egg; and (3) the incorporation of genetically manipulated embryonic stem cells into an early embryo. Production of the transgenic mice described above will facilitate the molecular elucidation of the role that a target protein plays in various cellular metabolic processes, including: aberrant lipid deposition, altered cellular metabolism and glucose regulation. Such mice provide an in vivo screening tool to study putative therapeutic drugs in a whole animal model and are encompassed by the present invention.

The term "animal" is used herein to include all vertebrate animals, except humans. It also includes an individual animal in all stages of development, including embryonic and fetal stages. A "transgenic animal" is any animal containing one or more cells bearing genetic information altered or received, directly or indirectly, by deliberate genetic manipulation at the subcellular level, such as by targeted recombination or microinjection or infection with recombinant virus. The term "transgenic animal" is not meant to encompass classical cross-breeding or in vitro fertilization, but rather is meant to encompass animals in which one or more cells are altered by or receive a recombinant DNA molecule. This molecule may be specifically targeted to a defined genetic locus, be randomly integrated within a chromosome, or it may be extrachromosomally replicating DNA. The term "germ cell line transgenic animal" refers to a transgenic animal in which the genetic alteration or genetic information was introduced into a germ line cell, thereby conferring the ability to transfer the genetic information to offspring. If such offspring, in fact, possess some or all of that alteration or genetic information, then they, too, are transgenic animals.

The alteration of genetic information may be foreign to the species of animal to which the recipient belongs, or foreign only to the particular individual recipient, or may be genetic information already possessed by the recipient. In the last case, the altered or introduced gene may be expressed differently than the native gene. Such altered or foreign genetic information would encompass the introduction of T1D-associated SNP containing nucleotide sequences.

The DNA used for altering a target gene may be obtained by a wide variety of techniques that include, but are not limited to, isolation from genomic sources, preparation of cDNAs from isolated mRNA templates, direct synthesis, or a combination thereof.

A preferred type of target cell for transgene introduction is the embryonal stem cell (ES). ES cells may be obtained from pre-implantation embryos cultured in vitro (Evans et al., (1981) Nature 292:154-156; Bradley et al., (1984) Nature 309:255-258; Gossler et al., (1986) Proc. Natl. Acad. Sci. 83:9065-9069). Transgenes can be efficiently introduced into the ES cells by standard techniques such as DNA transfection or by retrovirus-mediated transduction. The resultant transformed ES cells can thereafter be combined with blastocysts from a non-human animal. The introduced ES cells thereafter colonize the embryo and contribute to the germ line of the resulting chimeric animal.

One approach to the problem of determining the contributions of individual genes and their expression products is to use isolated T1D-associated SNP genes as insertional cassettes to selectively inactivate a wild-type gene in totipotent ES cells (such as those described above) and then generate transgenic mice. The use of gene-targeted ES cells in the generation of gene-targeted transgenic mice was described, and is reviewed elsewhere (Frohman et al., (1989) Cell 56:145-147; Bradley et al., (1992) Bio/Technology 10:534-539).

Techniques are available to inactivate or alter any genetic region to a mutation desired by using targeted homologous recombination to insert specific changes into chromosomal alleles. However, in comparison with homologous extrachromosomal recombination, which occurs at a frequency approaching 100%, homologous plasmid-chromosome recombination was originally reported to only be detected at frequencies between $10^{-6}$ and $10^{-3}$. Nonhomologous plasmid-chromosome interactions are more frequent occurring at levels $10^5$-fold to $10^2$ fold greater than comparable homologous insertion.

To overcome this low proportion of targeted recombination in murine ES cells, various strategies have been developed to detect or select rare homologous recombinants. One approach for detecting homologous alteration events uses the polymerase chain reaction (PCR) to screen pools of transformant cells for homologous insertion, followed by screening of individual clones. Alternatively, a positive genetic selection approach has been developed in which a marker gene is constructed which will only be active if homologous insertion occurs, allowing these recombinants to be selected directly. One of the most powerful approaches developed for selecting homologous recombinants is the positive-negative selection (PNS) method developed for genes for which no direct selection of the alteration exists. The PNS method is more efficient for targeting genes which are not expressed at high levels because the marker gene has its own promoter. Non-homologous recombinants are selected against by using the Herpes Simplex virus thymidine kinase (HSV-TK) gene and selecting against its nonhomologous insertion with effective herpes drugs such as gancyclovir (GANC) or (1-(2-deoxy-2-fluoro-B-D arabinofluranosyl)-5-iodou-racil, (FIAU). By this counter selection, the number of homologous recombinants in the surviving transformants can be increased. Utilizing T1D-associated SNP containing nucleic acid as a targeted insertional cassette provides means to detect a successful insertion as visualized, for example, by acquisition of immunoreactivity to an antibody immunologically specific for the polypeptide encoded by T1D-associated SNP nucleic acid and, therefore, facilitates screening/selection of ES cells with the desired genotype.

As used herein, a knock-in animal is one in which the endogenous murine gene, for example, has been replaced with human T1D-associated SNP containing gene of the invention. Such knock-in animals provide an ideal model system for studying the development of T1D.

As used herein, the expression of a T1D-associated SNP containing nucleic acid, fragment thereof, or a T1D-associated SNP fusion protein can be targeted in a "tissue specific manner" or "cell type specific manner" using a vector in which nucleic acid sequences encoding all or a portion of T1D-associated SNP are operably linked to regulatory sequences (e.g., promoters and/or enhancers) that direct expression of the encoded protein in a particular tissue or cell type. Such regulatory elements may be used to advantage for both in vitro and in vivo applications. Promoters for directing tissue specific expression of proteins are well known in the art and described herein.

The nucleic acid sequence encoding the T1D-associated SNP of the invention may be operably linked to a variety of different promoter sequences for expression in transgenic animals. Such promoters include, but are not limited to a prion gene promoter such as hamster and mouse Prion promoter (MoPrP), described in U.S. Pat. No. 5,877,399 and in Borchelt et al., Genet. Anal. 13(6) (1996) pages 159-163; a rat neuronal specific enolase promoter, described in U.S. Pat. Nos. 5,612,486, and 5,387,742; a platelet-derived growth factor B gene promoter, described in U.S. Pat. No. 5,811,633; a brain specific dystrophin promoter, described in U.S. Pat. No. 5,849,999; a Thy-1 promoter; a PGK promoter; a CMV promoter; a neuronal-specific platelet-derived growth factor B gene promoter; and Glial fibrillar acidic protein (GFAP) promoter for the expression of transgenes in glial cells.

Methods of use for the transgenic mice of the invention are also provided herein. Transgenic mice into which a nucleic acid containing the T1D-associated SNP or its encoded protein have been introduced are useful, for example, to develop screening methods to screen therapeutic agents to identify those capable of modulating the development of T1D.

Pharmaceuticals and Peptide Therapies

The elucidation of the role played by the T1D associated SNPs described herein in cellular metabolism facilitates the development of pharmaceutical compositions useful for treatment and diagnosis of T1D. These compositions may comprise, in addition to one of the above substances, a pharmaceutically acceptable excipient, carrier, buffer, stabilizer or other materials well known to those skilled in the art. Such materials should be non-toxic and should not interfere with the efficacy of the active ingredient.

Whether it is a polypeptide, antibody, peptide, nucleic acid molecule, small molecule or other pharmaceutically useful compound according to the present invention that is to be given to an individual, administration is preferably in a "prophylactically effective amount" or a "therapeutically effective amount" (as the case may be, although prophylaxis may be considered therapy), this being sufficient to show benefit to the individual.

As it is presently understood, RNA interference involves a multi-step process. Double stranded RNAs are cleaved by the endonuclease Dicer to generate nucleotide fragments (siRNA). The siRNA duplex is resolved into 2 single stranded RNAs, one strand being incorporated into a protein-containing complex where it functions as guide RNA to direct cleavage of the target RNA (Schwarz et al, Mol. Cell. 10:537 548 (2002), Zamore et al, Cell 101:25 33 (2000)), thus silencing a specific genetic message (see also Zeng et al, Proc. Natl. Acad. Sci. 100:9779 (2003)).

The invention includes a method of treating T1D in a mammal. Preferably, the mammal is a human, and the term "patient" as used herein refers to a human. An exemplary method entails administering to the mammal a pharmaceutically effective amount of siRNA directed to SNP sequences in a patient. The following discussion focuses on RPS26, but should be construed to also include siRNA directed to CDK2, ERBB3, IKZF4, RAB5B, and SUOX, all of which are considered for siRNA inhibition using the constructs in Tables 5-10. The siRNA inhibits the expression of wild type or variant-SNP-containing RPS26 sequences.

Specific siRNA preparations directed at inhibiting the expression of RPS26 or variant SNP-containing RPS26, as well as delivery methods are provided as a novel therapy to treat T1D. SiRNA oligonucleotides directed to RPS26 sequences specifically hybridize with nucleic acids encoding RPS26 and interfere with RPS26 gene expression. The siRNA can be delivered to a patient in vivo either systemically or locally with carriers, as discussed below. The compositions of the invention may be used alone or in combination with other agents or genes encoding proteins to augment the efficacy of the compositions.

A "membrane permeant peptide sequence" refers to a peptide sequence which is able to facilitate penetration and entry of the RPS26 inhibitor across the cell membrane. Exemplary peptides include with out limitation, the signal sequence from Karposi fibroblast growth factor exemplified herein, the HIV tat peptide (Vives et al., J. Biol. Chem., 272:16010-16017, 1997), Nontoxic membrane translocation peptide from protamine (Park et al., FASEB J. 19(11):1555-7, 2005), CHARIOTS delivery reagent (Active Motif; U.S. Pat. No. 6,841,535) and the antimicrobial peptide Buforin 2.

In one embodiment of the invention siRNAs are delivered for therapeutic benefit. There are several ways to administer the siRNA of the invention to in vivo to treat T1D including, but not limited to, naked siRNA delivery, siRNA conjugation and delivery, liposome carrier-mediated delivery, polymer carrier delivery, nanoparticle compositions, plasmid-based methods, and the use of viruses.

siRNA composition of the invention can comprise a delivery vehicle, including liposomes, for administration to a subject, carriers and diluents and their salts, and/or can be present in pharmaceutically acceptable formulations. This can be necessary to allow the siRNA to cross the cell membrane and escape degradation. Methods for the delivery of nucleic acid molecules are described in Akhtar et al., 1992, Trends Cell Bio., 2, 139; Delivery Strategies for Antisense Oligonucleotide Therapeutics, ed. Akhtar, 1995, Maurer et al., 1999, Mol. Membr. Biol., 16, 129-140; Hofland and Huang, 1999, Handb. Exp. Pharmacol., 137, 165-192; and Lee et al., 2000, ACS Symp. Ser., 752, 184-192; Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule.

The frequency of administration of the siRNA to a patient will also vary depending on several factors including, but not limited to, the type and severity of the T1D to be treated, the route of administration, the age and overall health of the individual, the nature of the siRNA, and the like. It is contemplated that the frequency of administration of the siRNA to the patient may vary from about once every few months to about once a month, to about once a week, to about once per day, to about several times daily.

Pharmaceutical compositions that are useful in the methods of the invention may be administered systemically in parenteral, oral solid and liquid formulations, ophthalmic, suppository, aerosol, topical or other similar formulations. In addition to the appropriate siRNA, these pharmaceutical compositions may contain pharmaceutically-acceptable carriers and other ingredients known to enhance and facilitate drug administration. Thus such compositions may optionally contain other components, such as adjuvants, e.g., aqueous suspensions of aluminum and magnesium hydroxides, and/or other pharmaceutically acceptable carriers, such as saline.

Other possible formulations, such as nanoparticles, liposomes, resealed erythrocytes, and immunologically based systems may also be used to administer the appropriate siRNA to a patient according to the methods of the invention. The use of nanoparticles to deliver siRNAs, as well as cell membrane permeable peptide carriers that can be used are described in Crombez et al., Biochemical Society Transactions v35:p44 (2007).

Methods of the invention directed to treating T1D involve the administration of RPS26 siRNA in a pharmaceutical composition. RPS26 siRNA is administered to an individual as a pharmaceutical composition comprising RPS26 siRNA and a pharmaceutically acceptable carrier. Pharmaceutically acceptable carriers are well known in the art and include aqueous solutions such as physiologically buffered saline, other solvents or vehicles such as glycols, glycerol, oils such as olive oil or injectable organic esters.

A pharmaceutically acceptable carrier can contain physiologically acceptable compounds that act, for example, to stabilize the RPS26 siRNA or increase the absorption of the agent. Such physiologically acceptable compounds include, for example, carbohydrates, such as glucose, sucrose or dextrans, antioxidants, such as ascorbic acid or glutathione, chelating agents, low molecular weight proteins or other stabilizers or excipients. One skilled in the art would know that the choice of a pharmaceutically acceptable carrier, including a physiologically acceptable compound, depends, for example, on the route of administration of the RPS26 siRNA.

One skilled in the art appreciates that a pharmaceutical composition comprising RPS26 siRNA can be administered to a subject by various routes including, for example, orally or parenterally, such as intravenously (i.v.), intramuscularly, subcutaneously, intraorbitally, intranasally, intracapsularly, intraperitoneally (i.p.), intracisternally, intra-tracheally (i.t.), or intra-articularly or by passive or facilitated absorption. The same routes of administration can be used other pharmaceutically useful compounds, for example, small molecules, nucleic acid molecules, peptides, antibodies and polypeptides as discussed herein.

A pharmaceutical composition comprising RPS26 siRNA inhibitor also can be incorporated, if desired, into liposomes, microspheres, microbubbles, or other polymer matrices (Gregoriadis, Liposome Technology, Vols. I to III, 2nd ed., CRC Press, Boca Raton Fla. (1993)). Liposomes, for example, which consist of phospholipids or other lipids, are nontoxic, physiologically acceptable and metabolizable carriers that are relatively simple to make and administer.

The pharmaceutical preparation comprises a siRNA targeting RPS26 or an expression vector encoding for an siRNA targeting RPS26 or SNP-containing RPS26. Such pharmaceutical preparations can be administered to a patient for treating T1D.

Expression vectors for the expression of siRNA molecules preferably employ a strong promoter which may be constitutive or regulated. Such promoters are well known in the art and include, but are not limited to, RNA polymerase II promoters, the T7 RNA polymerase promoter, and the RNA polymerase III promoters U6 and H1 (see, e.g., Myslinski et al. (2001) Nucl. Acids Res., 29:2502 09).

A formulated siRNA composition can be a composition comprising one or more siRNA molecules or a vector encoding one or more siRNA molecules independently or in combination with a cationic lipid, a neutral lipid, and/or a polyethyleneglycol-diacylglycerol (PEG-DAG) or PEG-cholesterol (PEG-Chol) conjugate. Non-limiting examples of expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500-505.

A lipid nanoparticle composition is a composition comprising one or more biologically active molecules independently or in combination with a cationic lipid, a neutral lipid, and/or a polyethyleneglycol-diacylglycerol (i.e., polyethyleneglycol diacylglycerol (PEG-DAG), PEG-cholesterol, or PEG-DMB) conjugate. In one embodiment, the biologically active molecule is encapsulated in the lipid nanoparticle as a result of the process of providing and aqueous solution comprising a biologically active molecule of the invention (i.e., siRNA), providing an organic solution comprising lipid nanoparticle, mixing the two solutions, incubating the solutions, dilution, ultrafiltration, resulting in concentrations suitable to produce nanoparticle compositions.

Nucleic acid molecules can be administered to cells by incorporation into other vehicles, such as biodegradable polymers, hydrogels, cyclodextrins. (see for example Gonzalez et al., 1999, Bioconjugate Chem., 10, 1068-1074; Wang et al., International PCT publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722)

Cationic lipids and polymers are two classes of non-viral siRNA delivery which can form complexes with negatively charged siRNA. The self-assembly PEG-ylated polycation polyethylenimine (PEI) has also been used to condense and protect siRNAs (Schiffelers et al., 2004, Nuc. Acids Res. 32: 141-110). The siRNA complex can be condensed into a nanoparticle to allow efficient uptake of the siRNA through endocytosis. Also, the nucleic acid-condensing property of protamine has been combined with specific antibodies to deliver siRNAs and can be used in the invention (Song et al., 2005, Nat. Biotech. 23:709-717).

In order to treat an individual having T1D, to alleviate a sign or symptom of the disease, RPS26 siRNA should be administered in an effective dose, and can be sirected to SNP containing RPS26 sequences. The total treatment dose can be administered to a subject as a single dose or can be administered using a fractionated treatment protocol, in which multiple doses are administered over a more prolonged period of time, for example, over the period of a day to allow administration of a daily dosage or over a longer period of time to administer a dose over a desired period of time. One skilled in the art would know that the amount of RPS26 siRNA required to obtain an effective dose in a subject depends on many factors, including the age, weight and general health of the subject, as well as the route of administration and the number of treatments to be administered. In view of these factors, the skilled artisan would adjust the particular dose so as to obtain an effective dose for treating an individual having T1D.

The effective dose of RPS26 siRNA will depend on the mode of administration, and the weight of the individual being treated. The dosages described herein are generally those for an average adult but can be adjusted for the treatment of children. *The dose will generally range from about 0.001 mg to about 1000 mg.*

The concentration of RPS26 siRNA in a particular formulation will depend on the mode and frequency of administration. A given daily dosage can be administered in a single dose or in multiple doses so long as the RPS26 siRNA concentration in the formulation results in the desired daily dosage. One skilled in the art can adjust the amount of RPS26 siRNA in the formulation to allow administration of a single dose or in multiple doses that provide the desired concentration of RPS26 siRNA over a given period of time.

In an individual suffering from T1D, in particular a more severe form of the disease, administration of RPS26 siRNA can be particularly useful when administered in combination, for example, with a conventional agent for treating such a disease. The skilled artisan would administer RPS26 siRNA, alone or in combination and would monitor the effectiveness of such treatment using routine methods such as pulmonary function determination, radiologic, immunologic or, where indicated, histopathologic methods. Other conventional agents for the treatment of diabetes include insulin administration, glucagon administration or agents that alter levels of either of these two molecules. Glucophage®, Avandia®, Actos®, Januvia® and Glucovance® are examples of such agents.

Administration of the pharmaceutical preparation is preferably in an "effective amount" this being sufficient to show benefit to the individual. This amount prevents, alleviates, abates, or otherwise reduces the severity of T1D symptoms in a patient.

The pharmaceutical preparation is formulated in dosage unit form for ease of administration and uniformity of dosage. Dosage unit form, as used herein, refers to a physically discrete unit of the pharmaceutical preparation appropriate for the patient undergoing treatment. Each dosage should contain a quantity of active ingredient calculated to produce the desired effect in association with the selected pharmaceutical carrier. Procedures for determining the appropriate dosage unit are well known to those skilled in the art.

Dosage units may be proportionately increased or decreased based on the weight of the patient. Appropriate concentrations for alleviation of a particular pathological condition may be determined by dosage concentration curve calculations, as known in the art.

As mentioned previously, a preferred embodiment of the invention comprises delivery of the SNP-containing RPS26 siRNA to a patient in need thereof, and candidate siRNA compositions for use in the invention are provided in Tables 5-10 (e.g., candidate siRNAs in Table 5=CDK2, Table 6=ERBB3, Table 7=IKZF4, Table 8=RAB5B, Table 9=RPS26, Table 10=SUOX). The sequences suitable for use include several siRNA duplexes (i.e., sense and antisense sequences for a gene target region), as well as several sequences of 'sense' strand alone. Those of skill in the art can determine the sequence of an antisense siRNA strand based on the disclosure of the sense strand, and will appreciate the difference between "U" and "T" designations in the sequences which correspond to RNA and DNA molecules, respectively.

The following examples are provided to illustrate certain embodiments of the invention. They are not intended to limit the invention in any way.

EXAMPLE I 550,000 single nucleotide polymorphisms (SNPs) were genotyped with the Illumina Human Hap550 Genotyping BeadChip[11] on the study population of 563 T1D probands of European ancestry and 1,146 controls without T1D and with matching ancestry (based on self report) plus 483 complete T1D family trios of the same ancestry. Following this process, 16 trios, 2 cases and 3 controls were removed due to genotyping yields <90%. All patients had clinically proven T1D.

In the case-control analysis, single-marker allele frequencies were compared using $\chi^2$ statistics for all markers while the transmission disequilibrium test (TDT) was used to calculate P-values of transmission distortion from heterozygous parents in affected parent-child trios. The resulting P-values from the case-control and family-based analyses were then combined using Fisher's method[12] to quantify the overall evidence for association.

Association signals were further assessed to identify signals that fulfilled the following criteria: (1) More than one SNP at a given locus exhibiting the same level of association in combined results from the Stage 1 case-control (after EIGENSTRAT adjustment for population stratification) and TDT analyses, with $P<1\times10^{-4}$; (2) the separate results from the Stage 1 case-control association and TDT analyses had to be P<0.05 each for more than one SNP at a given locus; (3) Odds ratios (OR) had to be in the same direction (more than one SNP at a given locus) in both the TDT and combined results.

Overall, 62 SNPs at a total of 24 loci satisfying the above criteria were selected (see Table 1). Following a replication attempt in the Stage 2 cohort, three SNPs at locus 18 resulted in significant association (see Table 2), namely allele G of rs10876864, allele C of rs1701704 and allele G of rs773107. These three SNPs reside on chromosome 12q13 in the vicinity of the following genes i.e. in a block of linkage disequilibrium: RAS-associated protein (RAB5B), in which rs773107 resides; Cyclin-dependent kinase 2 isoform 1 (CDK2); Sulfite oxidase (SUOX); Zinc finger protein subfamily 1A4 (IKZF4); Ribosomal protein S26 (RPS26); ErbB-3 isoform s precursor (ERBB3). As such, replicated association of T1D to a region on chromosome 12q13 harboring the genes RAB5B, CDK2, SUOX, IKZF4, RPS26 and ERBB3 has been observed.

Standard convention for presenting the risk conferred by a given SNP is to describe the risk numerically for the less frequent allele in the population i.e. the minor allele. On occasions, the minor allele is less frequent in the cases than in the controls and therefore yields a risk of less than 1 (i.e. it is termed "protective"). In this event, it is the major, or more common, allele that confers risk. SNPs that show association are not necessarily causative themselves, rather they tag the mutation which must reside on a nearby region (i.e. within a few kilobases). The causative mutation itself may confer higher risk and be rarer. Thus, the SNP association essentially indicates that there is a causative mutation nearby and that this SNP-containing gene is involved in the pathogenesis of the disease and therefore can be utilized to detect susceptibility thereto. Many surrogate SNPs can be employed to capture the same signal, and here they have been categorized into three parts: CATEGORY 1: r2>0.9; CATEGORY 2: r2=0.8-0.9; CATEGORY 3: r2<0.8-0.7; see Table 3. Surrogates for these three SNPs have also been identified and are provided in Table 3 below.

Down regulation of RPS26 mRNA expression levels (or any of the genes marked by the SNPs described herein, i.e., RAB5B, CDK2, SUOX, IKZF4, RPS26 and ERBB3) is desirable to inhibit production of the chromosome 12 gene product. Reduction in the expression level of this protein should impede or prevent the development of T1D. siRNA can be employed to regulate this locus, irrespective of the genetic status of the individual. Accordingly, candidate siRNA molecules to be delivered to patients are listed in Tables 5-10. The genetic status is useful to predict who will develop the disease so it can be determined who will particularly benefit from therapeutic intervention. Yet those individuals who do not have this specific genetic predisposition of T1D, but have a family history of the disease or have another type of genetic predisposition, could also benefit.

TABLE 1

Stage 1 candidate SNPs:

| Chr | Locus No | SNP | Allele | Case control P | TDT OR | TDT P | Combined P | Aff freq | Ctrl frq | OR |
|---|---|---|---|---|---|---|---|---|---|---|
| 1 | 1 | rs7543568 | C | 0.036 | 0.51 | $3.50 \times 10^{-4}$ | $2.00 \times 10^{-4}$ | 0.070 | 0.088 | 0.77 |
| 1 | 1 | rs12094260 | G | 0.0058 | 0.49 | 0.0017 | $1.00 \times 10^{-4}$ | 0.049 | 0.067 | 0.72 |
| 1 | 2 | rs2841578 | A | $1.50 \times 10^{-3}$ | 1.32 | 0.027 | $5.00 \times 10^{-4}$ | 0.159 | 0.132 | 1.25 |
| 1 | 2 | rs1452619 | G | $1.53 \times 10^{-3}$ | 1.34 | 0.022 | $4.00 \times 10^{-4}$ | 0.160 | 0.132 | 1.25 |
| 2 | 3 | rs6717144 | T | $9.82 \times 10^{-4}$ | 0.81 | 0.043 | $5.00 \times 10^{-4}$ | 0.274 | 0.305 | 0.86 |
| 2 | 3 | rs7605368 | A | $2.66 \times 10^{-3}$ | 0.70 | $2.26 \times 10^{-3}$ | $7.84 \times 10^{-5}$ | 0.194 | 0.226 | 0.83 |
| 2 | 3 | rs12617390 | G | $1.86 \times 10^{-3}$ | 0.71 | $4.90 \times 10^{-3}$ | $1.00 \times 10^{-4}$ | 0.198 | 0.231 | 0.82 |
| 2 | 4 | rs1348904 | G | 0.0043 | 1.29 | $9.38 \times 10^{-3}$ | $4.00 \times 10^{-4}$ | 0.373 | 0.331 | 1.21 |
| 2 | 4 | rs12467601 | C | 0.0050 | 1.27 | 0.013 | $7.00 \times 10^{-4}$ | 0.374 | 0.333 | 1.20 |
| 3 | 5 | rs2168422 | A | $6.99 \times 10^{-3}$ | 1.30 | 0.013 | $9.00 \times 10^{-4}$ | 0.293 | 0.252 | 1.24 |
| 3 | 5 | rs7621973 | C | $1.70 \times 10^{-2}$ | 1.36 | $4.67 \times 10^{-3}$ | $8.00 \times 10^{-4}$ | 0.270 | 0.235 | 1.20 |
| 3 | 5 | rs9310978 | A | 0.00362 | 1.26 | 0.025 | $9.00 \times 10^{-4}$ | 0.308 | 0.277 | 1.16 |
| 3 | 6 | rs694429 | G | 0.0017 | 1.34 | 0.015 | $3.00 \times 10^{-4}$ | 0.255 | 0.210 | 1.29 |
| 3 | 6 | rs792829 | G | $4.94 \times 10^{-2}$ | 1.38 | $1.60 \times 10^{-3}$ | $8.00 \times 10^{-4}$ | 0.369 | 0.336 | 1.15 |
| 3 | 7 | rs333335 | C | $1.76 \times 10^{-3}$ | 1.27 | 0.011 | $2.00 \times 10^{-4}$ | 0.458 | 0.411 | 1.21 |
| 3 | 7 | rs333318 | T | $6.35 \times 10^{-3}$ | 0.79 | 0.014 | $9.00 \times 10^{-4}$ | 0.415 | 0.447 | 0.88 |
| 4 | 8 | rs6856274 | G | $2.78 \times 10^{-5}$ | 1.26 | 0.040 | $1.62 \times 10^{-5}$ | 0.244 | 0.203 | 1.27 |
| 4 | 8 | rs1486993 | A | $2.26 \times 10^{-5}$ | 1.25 | 0.046 | $1.52 \times 10^{-5}$ | 0.244 | 0.203 | 1.27 |
| 4 | 8 | rs1486973 | T | $1.85 \times 10^{-4}$ | 1.28 | 0.029 | $6.94 \times 10^{-5}$ | 0.227 | 0.190 | 1.25 |
| 4 | 8 | rs4388143 | A | $1.28 \times 10^{-3}$ | 0.78 | $9.13 \times 10^{-3}$ | $1.00 \times 10^{-4}$ | 0.431 | 0.474 | 0.84 |
| 6 | 9 | rs214506 | C | 0.019 | 1.43 | $2.14 \times 10^{-4}$ | $5.34 \times 10^{-5}$ | 0.481 | 0.443 | 1.17 |
| 6 | 9 | rs214566 | G | 0.0015 | 1.33 | 0.037 | $6.00 \times 10^{-4}$ | 0.173 | 0.131 | 1.39 |
| 6 | 9 | rs214532 | A | 0.0029 | 1.32 | 0.013 | $4.00 \times 10^{-4}$ | 0.274 | 0.231 | 1.25 |
| 6 | 9 | rs445149 | G | 0.0060 | 1.33 | 0.012 | $8.00 \times 10^{-4}$ | 0.265 | 0.226 | 1.24 |
| 6 | 9 | rs725550 | G | 0.0078 | 0.66 | $8.50 \times 10^{-4}$ | $8.56 \times 10^{-5}$ | 0.178 | 0.218 | 0.78 |
| 6 | 10 | rs1471540 | T | 0.0011 | 1.32 | 0.025 | $3.00 \times 10^{-4}$ | 0.196 | 0.146 | 1.43 |
| 6 | 10 | rs597544 | T | 0.0017 | 1.33 | 0.046 | $8.00 \times 10^{-4}$ | 0.150 | 0.109 | 1.44 |
| 6 | 11 | rs9480754 | G | 0.0022 | 1.33 | 0.0060 | $2.00 \times 10^{-4}$ | 0.290 | 0.251 | 1.22 |
| 6 | 11 | rs7773295 | T | 0.0026 | 1.28 | 0.028 | $8.00 \times 10^{-4}$ | 0.225 | 0.184 | 1.28 |
| 7 | 12 | rs10243170 | G | 0.0030 | 0.68 | 0.0046 | $2.00 \times 10^{-4}$ | 0.120 | 0.130 | 0.91 |
| 7 | 12 | rs7778636 | A | 0.022 | 0.63 | 0.0039 | $9.00 \times 10^{-4}$ | 0.085 | 0.088 | 0.96 |
| 9 | 13 | rs10758593 | A | $8.62 \times 10^{-4}$ | 1.22 | 0.037 | $4.00 \times 10^{-4}$ | 0.492 | 0.426 | 1.30 |
| 9 | 13 | rs10758594 | A | 0.0014 | 1.21 | 0.041 | $6.00 \times 10^{-4}$ | 0.513 | 0.451 | 1.28 |
| 9 | 14 | rs824265 | C | 0.0092 | 0.61 | 0.0017 | $2.00 \times 10^{-4}$ | 0.104 | 0.123 | 0.83 |
| 9 | 14 | rs824241 | A | 0.0079 | 0.67 | 0.0061 | $5.00 \times 10^{-4}$ | 0.108 | 0.127 | 0.83 |
| 10 | 15 | rs4918487 | T | 0.0064 | 1.39 | 0.011 | $7.00 \times 10^{-4}$ | 0.202 | 0.153 | 1.40 |
| 10 | 15 | rs7917093 | A | 0.0079 | 1.39 | 0.011 | $9.00 \times 10^{-4}$ | 0.204 | 0.156 | 1.39 |
| 11 | 16 | rs4754458 | A | 0.0019 | 0.72 | $3.34 \times 10^{-3}$ | $8.14 \times 10^{-5}$ | 0.230 | 0.242 | 0.94 |
| 11 | 16 | rs12790005 | C | $2.47 \times 10^{-3}$ | 1.74 | $2.45 \times 10^{-3}$ | $7.88 \times 10^{-5}$ | 0.084 | 0.070 | 1.21 |
| 11 | 16 | rs11822881 | A | 0.0037 | 1.55 | 0.016 | $6.00 \times 10^{-4}$ | 0.080 | 0.067 | 1.21 |
| 11 | 16 | rs10488765 | G | 0.0092 | 1.63 | $6.35 \times 10^{-3}$ | $6.00 \times 10^{-4}$ | 0.079 | 0.069 | 1.15 |
| 12 | 17 | rs11048030 | A | $8.74 \times 10^{-4}$ | 1.59 | 0.010 | $1.00 \times 10^{-4}$ | 0.102 | 0.080 | 1.31 |
| 12 | 17 | rs7398236 | C | 0.0011 | 1.64 | $9.33 \times 10^{-3}$ | $1.00 \times 10^{-4}$ | 0.101 | 0.078 | 1.32 |
| 12 | 18 | rs2069408 | G | $5.12 \times 10^{-3}$ | 1.29 | 0.011 | $6.00 \times 10^{-4}$ | 0.357 | 0.305 | 1.27 |
| 12 | 18 | rs773107 | G | $3.20 \times 10^{-5}$ | 1.31 | $7.81 \times 10^{-3}$ | $4.05 \times 10^{-6}$ | 0.366 | 0.295 | 1.38 |
| 12 | 18 | rs10876864 | G | $2.07 \times 10^{-4}$ | 1.41 | $2.97 \times 10^{-4}$ | $1.08 \times 10^{-6}$ | 0.458 | 0.388 | 1.34 |
| 12 | 18 | rs1701704 | C | $2.46 \times 10^{-5}$ | 1.36 | 0.0016 | $7.16 \times 10^{-7}$ | 0.379 | 0.303 | 1.40 |
| 12 | 18 | rs705708 | G | $7.08 \times 10^{-4}$ | 1.22 | 0.028 | $2.00 \times 10^{-4}$ | 0.507 | 0.461 | 1.21 |
| 15 | 19 | rs1424695 | A | $3.34 \times 10^{-3}$ | 0.74 | 0.0021 | $8.94 \times 10^{-5}$ | 0.390 | 0.422 | 0.88 |
| 15 | 19 | rs1048048 | T | $2.31 \times 10^{-4}$ | 0.76 | $4.56 \times 10^{-3}$ | $1.55 \times 10^{-5}$ | 0.300 | 0.335 | 0.85 |
| 16 | 20 | rs151230 | T | 0.013 | 1.44 | $6.04 \times 10^{-3}$ | $8.00 \times 10^{-4}$ | 0.161 | 0.139 | 1.19 |
| 16 | 20 | rs9924471 | T | 0.0040 | 1.34 | 0.013 | $6.00 \times 10^{-4}$ | 0.208 | 0.175 | 1.24 |
| 18 | 21 | rs543347 | T | $1.37 \times 10^{-3}$ | 0.70 | $4.67 \times 10^{-3}$ | $8.27 \times 10^{-5}$ | 0.111 | 0.147 | 0.72 |
| 18 | 21 | rs540101 | A | $1.78 \times 10^{-3}$ | 0.71 | $6.43 \times 10^{-3}$ | $1.00 \times 10^{-4}$ | 0.111 | 0.147 | 0.72 |
| 19 | 22 | rs602662 | G | $4.48 \times 10^{-4}$ | 0.74 | $1.82 \times 10^{-3}$ | $1.23 \times 10^{-5}$ | 0.450 | 0.491 | 0.85 |
| 19 | 22 | rs485186 | T | $1.86 \times 10^{-4}$ | 0.75 | $2.31 \times 10^{-3}$ | $6.73 \times 10^{-6}$ | 0.445 | 0.490 | 0.83 |
| 19 | 22 | rs504963 | C | $5.09 \times 10^{-4}$ | 0.75 | $2.04 \times 10^{-3}$ | $1.54 \times 10^{-5}$ | 0.449 | 0.491 | 0.84 |
| 20 | 23 | rs6076595 | C | 0.0019 | 0.79 | 0.032 | $7.00 \times 10^{-4}$ | 0.184 | 0.232 | 0.75 |
| 20 | 23 | rs8119653 | G | $3.89 \times 10^{-3}$ | 0.78 | 0.013 | $5.00 \times 10^{-4}$ | 0.252 | 0.316 | 0.73 |
| X | 24 | rs12854493 | A | 0.018 | 1.67 | 0.0039 | $8.00 \times 10^{-4}$ | 0.189 | 0.169 | 1.15 |
| X | 24 | rs5907223 | T | 0.00142 | 1.41 | 0.039 | $6.00 \times 10^{-4}$ | 0.238 | 0.191 | 1.32 |
| X | 24 | rs7889974 | G | $5.55 \times 10^{-4}$ | 1.59 | 0.015 | $1.00 \times 10^{-4}$ | 0.165 | 0.132 | 1.30 |

TABLE 2

Stage 2 results for locus 18 on chromosome 12q13.

| CHR | SNP | T:U TDT | TDT OR | TDT Chi-square | TDT P |
|---|---|---|---|---|---|
| 12 | rs10876864 | 678:550 | 1.233 | 13.34 | $2.60 \times 10^{-4}$ |
| 12 | rs1701704 | 635:506 | 1.255 | 14.58 | $1.34 \times 10^{-4}$ |
| 12 | rs773107 | 609:491 | 1.24 | 12.66 | $3.74 \times 10^{-4}$ |

TABLE 3

All HapMap SNPs in the linkage disequilibrium block that have r2 > 0.5 in CEPH Utah Caucasians (CEU) to the three SNPs on 12q13 (rs10876864, rs1701704 and rs773107).

| #pos1 | pos2 | pop | marker1 | marker2 | D' | r² |
|---|---|---|---|---|---|---|
| 54660962 | 54655773 | CEU | rs773109 | rs773107 | 1 | 0.959 |
| 54670954 | 54655773 | CEU | rs705698 | rs773107 | 1 | 0.959 |
| 54676903 | 54655773 | CEU | rs705702 | rs773107 | 1 | 0.959 |
| 54656178 | 54655773 | CEU | rs773108 | rs773107 | 1 | 0.957 |
| 54721679 | 54655773 | CEU | rs705704 | rs773107 | 0.957 | 0.877 |
| 54689844 | 54655773 | CEU | rs772921 | rs773107 | 0.957 | 0.844 |
| 54698754 | 54655773 | CEU | rs1701704 | rs773107 | 0.957 | 0.844 |
| 54703195 | 54655773 | CEU | rs2456973 | rs773107 | 0.957 | 0.843 |
| 54768447 | 54655773 | CEU | rs2292239 | rs773107 | 0.957 | 0.81 |
| 54766850 | 54655773 | CEU | rs877636 | rs773107 | 0.954 | 0.801 |
| 54665327 | 54655773 | CEU | rs773114 | rs773107 | 1 | 0.655 |
| 54665694 | 54655773 | CEU | rs1873914 | rs773107 | 1 | 0.655 |
| 54687352 | 54655773 | CEU | rs10876864 | rs773107 | 0.951 | 0.615 |
| 54756892 | 54655773 | CEU | rs11171739 | rs773107 | 0.95 | 0.571 |
| 54763961 | 54655773 | CEU | rs2271194 | rs773107 | 0.95 | 0.571 |
| 54689844 | 54698754 | CEU | rs772921 | rs1701704 | 1 | 1 |
| 54703195 | 54698754 | CEU | rs2456973 | rs1701704 | 1 | 1 |
| 54721679 | 54698754 | CEU | rs705704 | rs1701704 | 1 | 1 |
| 54768447 | 54698754 | CEU | rs2292239 | rs1701704 | 0.959 | 0.884 |
| 54660962 | 54698754 | CEU | rs773109 | rs1701704 | 0.958 | 0.882 |
| 54676903 | 54698754 | CEU | rs705702 | rs1701704 | 0.958 | 0.882 |
| 54670954 | 54698754 | CEU | rs705698 | rs1701704 | 0.958 | 0.882 |
| 54766850 | 54698754 | CEU | rs877636 | rs1701704 | 0.957 | 0.878 |
| 54656178 | 54698754 | CEU | rs773108 | rs1701704 | 0.956 | 0.876 |
| 54756892 | 54698754 | CEU | rs11171739 | rs1701704 | 0.954 | 0.624 |
| 54763961 | 54698754 | CEU | rs2271194 | rs1701704 | 0.953 | 0.624 |
| 54665327 | 54698754 | CEU | rs773114 | rs1701704 | 0.908 | 0.587 |
| 54665694 | 54698754 | CEU | rs1873914 | rs1701704 | 0.908 | 0.587 |
| 54794676 | 54698754 | CEU | rs4759228 | rs1701704 | 0.804 | 0.501 |
| 54665327 | 54687352 | CEU | rs773114 | rs10876864 | 0.963 | 0.895 |
| 54665694 | 54687352 | CEU | rs1873914 | rs10876864 | 0.963 | 0.895 |
| 54756892 | 54687352 | CEU | rs11171739 | rs10876864 | 0.963 | 0.862 |
| 54763961 | 54687352 | CEU | rs2271194 | rs10876864 | 0.963 | 0.862 |
| 54721679 | 54687352 | CEU | rs705704 | rs10876864 | 1 | 0.703 |
| 54656178 | 54687352 | CEU | rs773108 | rs10876864 | 0.952 | 0.681 |
| 54689844 | 54687352 | CEU | rs772921 | rs10876864 | 0.955 | 0.672 |
| 54698754 | 54687352 | CEU | rs1701704 | rs10876864 | 0.955 | 0.672 |
| 54703195 | 54687352 | CEU | rs2456973 | rs10876864 | 0.954 | 0.669 |
| 54660962 | 54687352 | CEU | rs773109 | rs10876864 | 0.953 | 0.643 |
| 54676903 | 54687352 | CEU | rs705702 | rs10876864 | 0.953 | 0.643 |
| 54670954 | 54687352 | CEU | rs705698 | rs10876864 | 0.953 | 0.643 |
| 54768447 | 54687352 | CEU | rs2292239 | rs10876864 | 0.867 | 0.577 |
| 54766850 | 54687352 | CEU | rs877636 | rs10876864 | 0.861 | 0.562 |

EXAMPLE II

To determine if mRNA expression of any of the six genes at the 12q13 locus were under regulatory influence of the SNPs that are present on the HumanHap550 SNP chip and showing association with T1D, the "mRNA by SNP Browser" program was used to query the genes residing within the 12q13 locus with respect to correlation with expression quantitative trait loci (eQTLs). This program can be found on the world wide web at: (sph.umich.edu/csg/liang/asthma). A strong correlation was observed between the most significant T1D associated SNPs and eQTLs for the RPS26 gene (see Table 4). None of the other five genes demonstrated eQTL signals.

TABLE 4 eQTL correlation with two Affymetrix probes for the RPS26 gene and the most significant T1D associated SNPs at the 12q13 locus.

| Affymetrix Probe | SNP ID | Effect | H2 | LOD | P-value |
|---|---|---|---|---|---|
| 217753_s_at | rs10876864 | −1.141 | 63.97 | 46.38 | $2.30 \times 10^{-48}$ |
| 234885_at | rs10876864 | −0.57 | 15.98 | 11.65 | $2.40 \times 10^{-13}$ |
| 217753_s_at | rs1701704 | −1.024 | 47.75 | 33.04 | $5.80 \times 10^{-35}$ |
| 234885_at | rs1701704 | −0.532 | 12.88 | 9.14 | $8.80 \times 10^{-11}$ |
| 217753_s_at | rs773107 | −0.941 | 39.77 | 27.88 | $9.20 \times 10^{-30}$ |
| 234885_at | rs773107 | −0.474 | 10.06 | 7.24 | $7.70 \times 10^{-9}$ |

These data show that the RPS26 gene is under strong regulatory influence of the SNPs that associate with T1D at the 12q13 locus. While all six genes may contribute to development of T1D, these data suggest that the RPS26 gene may be most influential in the pathogenesis of T1D. Tables 5-10 below contain candidate siRNA constructs directed to the genes at chromosome 12q13.

TABLE 5

Candidate siRNAs for CDK2, SEQ ID NOs: 12-251 are based on NM_052827 and SEQ ID NOs: 252-488 are based on NM_001798.

| SEQ ID NO: 12 | CCAGAGGCCCCGCCCCUGCtt |
| SEQ ID NO: 13 | GUUGCCGCCUCCCACCGAGtt |
| SEQ ID NO: 14 | UGGCCAACUUGAAACAAUGtt |
| SEQ ID NO: 15 | UCUUGUCAAUUUGGCCAACtt |
| SEQ ID NO: 16 | ACCUCUCGCUCUUGUCAAUtt |
| SEQ ID NO: 17 | CGCAGUAUACCUCUCGCUCtt |
| SEQ ID NO: 18 | CUUUUCCACCUUUUGGAAGtt |
| SEQ ID NO: 19 | CUCCGAUCUUUUCCACCUUtt |
| SEQ ID NO: 20 | CUCUCCGAUCUUUUCCACCtt |
| SEQ ID NO: 21 | ACGUGCCCUCUCCGAUCUUtt |
| SEQ ID NO: 22 | GUACGUGCCCUCUCCGAUCtt |
| SEQ ID NO: 23 | CGUCAACUUGUUUCUGGCUtt |
| SEQ ID NO: 24 | ACCUCUCCCGUCAACUUGUtt |
| SEQ ID NO: 25 | CACCACCUCUCCCGUCAACtt |
| SEQ ID NO: 26 | AGUGUCCAGGCGGAUUUUCtt |
| SEQ ID NO: 27 | CUCAGUGUCCAGGCGGAUUtt |
| SEQ ID NO: 28 | GUCUCAGUGUCCAGGCGGAtt |
| SEQ ID NO: 29 | AUUAGGAUGGUUAAGCUCCtt |
| SEQ ID NO: 30 | CUUGACAAUAUUAGGAUGGtt |
| SEQ ID NO: 31 | AUCCAGCAGCUUGACAAUAtt |
| SEQ ID NO: 32 | GUGAAUGACAUCCAGCAGCtt |
| SEQ ID NO: 33 | AAACCAGGUAGAGUUUAUUtt |
| SEQ ID NO: 34 | AAAAACCAGGUAGAGUUUAtt |
| SEQ ID NO: 35 | UUCAAAAACCAGGUAGAGUtt |
| SEQ ID NO: 36 | UGAGAUCUUGGUGCAGAAAtt |
| SEQ ID NO: 37 | CCAUGAAUUUCUUGAGAUCtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 38 | AGAGGCAUCCAUGAAUUUCtt |
| SEQ ID NO: 39 | AGCAGAGGCAUCCAUGAAUtt |
| SEQ ID NO: 40 | CAGCUGGAACAGAUAGCUCtt |
| SEQ ID NO: 41 | AAUAAGCAGAUUCUGAGGUtt |
| SEQ ID NO: 42 | CUCUGUGUUAAUAAGCAGAtt |
| SEQ ID NO: 43 | CUUGAUGGCCCCCUCUGUGtt |
| SEQ ID NO: 44 | UAGUCCAAAGUCUGCUAGCtt |
| SEQ ID NO: 45 | CCACUUGGGGAAACUUGGCtt |
| SEQ ID NO: 46 | CGGGCCCACUUGGGGAAACtt |
| SEQ ID NO: 47 | AAAAUCUUGCCGGGCCCACtt |
| SEQ ID NO: 48 | GUACAACUUUACUAAAAUCtt |
| SEQ ID NO: 49 | AUCCAGGGGAGGUACAACUtt |
| SEQ ID NO: 50 | AUAACAAGCUCCGUCCAUCtt |
| SEQ ID NO: 51 | UAGGGUCGUAGUGCAGCAUtt |
| SEQ ID NO: 52 | CUUGGCCGAAAUCCGCUUGtt |
| SEQ ID NO: 53 | UGCCUUGGCCGAAAUCCGCtt |
| SEQ ID NO: 54 | AGGGUGAGCCAGGGCUGCCtt |
| SEQ ID NO: 55 | UCGAAGAUGGGGUACUGGCtt |
| SEQ ID NO: 56 | UGAGAUUAGGGCUGGGGCtt |
| SEQ ID NO: 57 | ACUGGAGGAGGGUGAGAtt |
| SEQ ID NO: 58 | GGUGAGUGUUUAAGGCAAGtt |
| SEQ ID NO: 59 | AAGACUAGAAGGUGAGUGUtt |
| SEQ ID NO: 60 | CACCCCUGUAUUCCCAGAGtt |
| SEQ ID NO: 61 | CCCCCCUUUCACCCCUGUAtt |
| SEQ ID NO: 62 | UUUUCACUGGUUCCCCCCUtt |
| SEQ ID NO: 63 | UUCCUUUCAUUUUCACUGGtt |
| SEQ ID NO: 64 | ACUGAAACUUCCUUUCAUUtt |
| SEQ ID NO: 65 | AUACUGAAACUUCCUUUCAtt |
| SEQ ID NO: 66 | UCUAAUACUGAAACUUCCUtt |
| SEQ ID NO: 67 | GUGCAUCUAAUACUGAAACtt |
| SEQ ID NO: 68 | AAGGGUGGUGGAGGCUAACtt |
| SEQ ID NO: 69 | UAUUUUUAUACCAACCCUCtt |
| SEQ ID NO: 70 | GGCUUUUUUAAAAUUAUUUtt |
| SEQ ID NO: 71 | AAGGCUUUUUUAAAAUUAUtt |
| SEQ ID NO: 72 | UAGGAAGGCUUUUUUAAAAtt |
| SEQ ID NO: 73 | AACGUGUAGGAAGGCUUUUtt |
| SEQ ID NO: 74 | CUAACGUGUAGGAAGGCUUtt |
| SEQ ID NO: 75 | AUCUAACGUGUAGGAAGGCtt |
| SEQ ID NO: 76 | AUUAUGGGCAUUCAGAGAtt |
| SEQ ID NO: 77 | AAAUAAUAAUUAUGGGGCAtt |
| SEQ ID NO: 78 | CAAACACUGGAAAUAAUAAtt |
| SEQ ID NO: 79 | CAUUGUGGCAGCAGGAGGCtt |
| SEQ ID NO: 80 | CAUUUGGCCUUUAUAAACAtt |
| SEQ ID NO: 81 | CCCCGCUAUCAUUUGGCCUtt |
| SEQ ID NO: 82 | ACUUAGCCCCCGCUAUCAUtt |
| SEQ ID NO: 83 | GGUUCUCAAAAGCACCAACtt |
| SEQ ID NO: 84 | GUGGUUUUGUUUUACUUGGtt |
| SEQ ID NO: 85 | CCCAGUGGUUUUGUUUUACtt |
| SEQ ID NO: 86 | UCCUCCCAGUGGUUUUGUUtt |
| SEQ ID NO: 87 | ACUCCUCCCAGUGGUUUUGtt |
| SEQ ID NO: 88 | UAGACUCCUCCCAGUGGUUtt |
| SEQ ID NO: 89 | AAUAGACUCCUCCCAGUGGtt |
| SEQ ID NO: 90 | AUUUUUUCAACCGAAUUCUtt |
| SEQ ID NO: 91 | AUCUAUUUUUCAACCGAAtt |
| SEQ ID NO: 92 | AACUGAUUGGAUCUAUUUUtt |
| SEQ ID NO: 93 | UAAACUGAUUGGAUCUAUUtt |
| SEQ ID NO: 94 | UAUAAACUGAUUGGAUCUAtt |
| SEQ ID NO: 95 | UAACUAGGGUAUAAACUGAtt |
| SEQ ID NO: 96 | UCUUCAGUCUCCCAGCCUAtt |
| SEQ ID NO: 97 | GCCCCACCCGGGCUGAGUCtt |
| SEQ ID NO: 98 | GGACUGGGGCCAAUCAUUUtt |
| SEQ ID NO: 99 | GGGGACUGGGGCCAAUCAUtt |
| SEQ ID NO: 100 | UGUCUCAGGGCCUCCCAGAtt |
| SEQ ID NO: 101 | GCCAUGGUGAAGCAAUAGAtt |
| SEQ ID NO: 102 | ACUAAAAGGAAGAGAAAAAtt |
| SEQ ID NO: 103 | AAAAUGGGAUCAGGGAUCCtt |
| SEQ ID NO: 104 | AUGAUGCCUAAACCCUAACtt |
| SEQ ID NO: 105 | CCCUGAAAAGUGUCAGCAtt |
| SEQ ID NO: 106 | UUCUUUUAAAGAAAUAUUUtt |
| SEQ ID NO: 107 | CCUUCUUUUAAAGAAAUAUtt |
| SEQ ID NO: 108 | AUAAUUGUUCAUCCUUCUUtt |
| SEQ ID NO: 109 | AUAUAAUUGUUCAUCCUUCtt |
| SEQ ID NO: 110 | UAAAUAUAAUUGUUCAUCCtt |
| SEQ ID NO: 111 | UGAAAUAUAAAUAUAAUUGtt |
| SEQ ID NO: 112 | ACCUGAAAUAUAAAUAUAAtt |
| SEQ ID NO: 113 | AAAAAAGCCAACUCUACUAtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 114 | UUUUUUUUUAGCACUGUCAtt |
| SEQ ID NO: 115 | AAAAAAAUGCUUUUUUUUUtt |
| SEQ ID NO: 116 | AAAAAAAAAUGCUUUUUUUtt |
| SEQ ID NO: 117 | UAAAAAAAAAAUGCUUUUUtt |
| SEQ ID NO: 118 | CAUAAAAAAAAAAUGCUUUtt |
| SEQ ID NO: 119 | AUCAUAAAAAAAAAAUGCUtt |
| SEQ ID NO: 120 | AACUAAAUUACAAAUAACGtt |
| SEQ ID NO: 121 | UAAUGAGCUACAAACUAAAtt |
| SEQ ID NO: 122 | UAAAACUAGGCACAUUUUUtt |
| SEQ ID NO: 123 | UAUAAACUAGGCACAUUUUtt |
| SEQ ID NO: 124 | UUUAUAAACUAGGCACAUtt |
| SEQ ID NO: 125 | UUGUUUUUUUUUUUUUUUtt |
| SEQ ID NO: 126 | UUUUGUUUUUUUUUUUUUUtt |
| SEQ ID NO: 127 | UUUUUUGUUUUUUUUUUUUtt |
| SEQ ID NO: 128 | UUUUUUUUGUUUUUUUUUUtt |
| SEQ ID NO: 129 | UUUUUUUUUUGUUUUUUUUtt |
| SEQ ID NO: 130 | UUUUUUUUUUUGUUUUUUUtt |
| SEQ ID NO: 131 | UUUUUUUUUUUUUGUUUUUtt |
| SEQ ID NO: 132 | GCAGGGGCGGGGCCUCUGGtt |
| SEQ ID NO: 133 | CUCGGUGGGAGGCGGCAACtt |
| SEQ ID NO: 134 | CAUUGUUUCAAGUUGGCCAtt |
| SEQ ID NO: 135 | GUUGGCCAAAUUGACAAGAtt |
| SEQ ID NO: 136 | AUUGACAAGAGCGAGAGGUtt |
| SEQ ID NO: 137 | GAGCGAGAGGUAUACUGCGtt |
| SEQ ID NO: 138 | CUUCCAAAAGGUGGAAAAGtt |
| SEQ ID NO: 139 | AAGGUGGAAAAGAUCGGAGtt |
| SEQ ID NO: 140 | GGUGGAAAAGAUCGGAGAGtt |
| SEQ ID NO: 141 | AAGAUCGGAGAGGGCACGUtt |
| SEQ ID NO: 142 | GAUCGGAGAGGGCACGUACtt |
| SEQ ID NO: 143 | AGCCAGAAACAAGUUGACGtt |
| SEQ ID NO: 144 | ACAAGUUGACGGGAGAGGUtt |
| SEQ ID NO: 145 | GUUGACGGGAGAGGUGGUGtt |
| SEQ ID NO: 146 | GAAAUCCGCCUGGACACUtt |
| SEQ ID NO: 147 | AAUCCGCCUGGACACUGAGtt |
| SEQ ID NO: 148 | UCCGCCUGGACACUGAGACtt |
| SEQ ID NO: 149 | GGAGCUUAACCAUCCUAAUtt |
| SEQ ID NO: 150 | CCAUCCUAAUAUUGUCAAGtt |
| SEQ ID NO: 151 | UAUUGUCAAGCUGCUGGAUtt |
| SEQ ID NO: 152 | GCUGCUGGAUGUCAUUCACtt |
| SEQ ID NO: 153 | AAUAAACUCUACCUGGUUUtt |
| SEQ ID NO: 154 | UAAACUCUACCUGGUUUUUtt |
| SEQ ID NO: 155 | ACUCUACCUGGUUUUUGAAtt |
| SEQ ID NO: 156 | UUUCUGCACCAAGAUCUCAtt |
| SEQ ID NO: 157 | GAUCUCAAGAAAUUCAUGGtt |
| SEQ ID NO: 158 | GAAAUUCAUGGAUGCCUCUtt |
| SEQ ID NO: 159 | AUUCAUGGAUGCCUCUGCUtt |
| SEQ ID NO: 160 | GAGCUAUCUGUUCCAGCUGtt |
| SEQ ID NO: 161 | ACCUCAGAAUCUGCUUAUUtt |
| SEQ ID NO: 162 | UCUGCUUAUUAACACAGAGtt |
| SEQ ID NO: 163 | CACAGAGGGGGCCAUCAAGtt |
| SEQ ID NO: 164 | GCUAGCAGACUUUGGACUAtt |
| SEQ ID NO: 165 | GCCAAGUUUCCCCAAGUGGtt |
| SEQ ID NO: 166 | GUUUCCCCAAGUGGGCCCGtt |
| SEQ ID NO: 167 | GUGGGCCCGGCAAGAUUUUtt |
| SEQ ID NO: 168 | GAUUUUAGUAAAGUUGUACtt |
| SEQ ID NO: 169 | AGUUGUACCUCCCCUGGAUtt |
| SEQ ID NO: 170 | GAUGGACGGAGCUUGUUAUtt |
| SEQ ID NO: 171 | AUGCUGCACUACGACCCUAtt |
| SEQ ID NO: 172 | CAAGCGGAUUUCGGCCAAGtt |
| SEQ ID NO: 173 | GCGGAUUUCGGCCAAGGCAtt |
| SEQ ID NO: 174 | GGCAGCCCUGGCUCACCCUtt |
| SEQ ID NO: 175 | GCCAGUACCCCAUCUUCGAtt |
| SEQ ID NO: 176 | GCCCCCAGCCCUAAUCUCAtt |
| SEQ ID NO: 177 | UCUCACCCUCUCCUCCAGUtt |
| SEQ ID NO: 178 | CUUGCCUUAAACACUCACCtt |
| SEQ ID NO: 179 | ACACUCACCUUCUAGUCUUtt |
| SEQ ID NO: 180 | CUCUGGGAAUACAGGGGUGtt |
| SEQ ID NO: 181 | UACAGGGGUGAAAGGGGGGtt |
| SEQ ID NO: 182 | AGGGGGGAACCAGUGAAAAtt |
| SEQ ID NO: 183 | CCAGUGAAAAUGAAAGGAAtt |
| SEQ ID NO: 184 | AAUGAAAGGAAGUUUCAGUtt |
| SEQ ID NO: 185 | UGAAAGGAAGUUUCAGUAUtt |
| SEQ ID NO: 186 | AGGAAGUUUCAGUAUUAGAtt |
| SEQ ID NO: 187 | GUUUCAGUAUUAGAUGCACtt |
| SEQ ID NO: 188 | GUUAGCCUCCACCACCCUUtt |
| SEQ ID NO: 189 | GAGGGUUGGUAUAAAAAUAtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 190 | AAAUAAUUUAAAAAAGCCUtt |
| SEQ ID NO: 191 | AUAAUUUUAAAAAGCCUUtt |
| SEQ ID NO: 192 | UUUUAAAAAGCCUUCCUAtt |
| SEQ ID NO: 193 | AAAAGCCUUCCUACACGUUtt |
| SEQ ID NO: 194 | AAGCCUUCCUACACGUUAGtt |
| SEQ ID NO: 195 | GCCUUCCUACACGUUAGAUtt |
| SEQ ID NO: 196 | UCUCUGAAUGCCCCAUAAUtt |
| SEQ ID NO: 197 | UGCCCCAUAAUUAUAUUUtt |
| SEQ ID NO: 198 | UUAUUAUUCCAGUGUUUGtt |
| SEQ ID NO: 199 | GCCUCCUGCUGCCACAAUGtt |
| SEQ ID NO: 200 | UGUUUAUAAAGGCCAAAUGtt |
| SEQ ID NO: 201 | AGGCCAAAUGAUAGCGGGGtt |
| SEQ ID NO: 202 | AUGAUAGCGGGGGCUAAGUtt |
| SEQ ID NO: 203 | GUUGGUGCUUUUGAGAACCtt |
| SEQ ID NO: 204 | CCAAGUAAAACAAAACCACtt |
| SEQ ID NO: 205 | GUAAAACAAAACCACUGGGtt |
| SEQ ID NO: 206 | AACAAAACCACUGGGAGGAtt |
| SEQ ID NO: 207 | CAAAACCACUGGGAGGAGUtt |
| SEQ ID NO: 208 | AACCACUGGGAGGAGUCUAtt |
| SEQ ID NO: 209 | CCACUGGGAGGAGUCUAUUtt |
| SEQ ID NO: 210 | AGAAUUCGGUUGAAAAAAUtt |
| SEQ ID NO: 211 | UUCGGUUGAAAAAAUAGAUtt |
| SEQ ID NO: 212 | AAAAUAGAUCCAAUCAGUUtt |
| SEQ ID NO: 213 | AAUAGAUCCAAUCAGUUUAtt |
| SEQ ID NO: 214 | UAGAUCCAAUCAGUUUAUAtt |
| SEQ ID NO: 215 | UCAGUUUAUACCCUAGUUAtt |
| SEQ ID NO: 216 | UAGGCUGGGAGACUGAAGAtt |
| SEQ ID NO: 217 | GACUCAGCCCGGGUGGGCtt |
| SEQ ID NO: 218 | AAAUGAUUGGCCCCAGUCCtt |
| SEQ ID NO: 219 | AUGAUUGGCCCCAGUCCCCtt |
| SEQ ID NO: 220 | UCUGGGAGGCCCUGAGACAtt |
| SEQ ID NO: 221 | UCUAUUGCUUCACCAUGGCtt |
| SEQ ID NO: 222 | UUUUUCUCUUCCUUUUAGUtt |
| SEQ ID NO: 223 | GGAUCCCUGAUCCCAUUUUtt |
| SEQ ID NO: 224 | GUUAGGGUUUAGGCAUCAUtt |
| SEQ ID NO: 225 | UGCUGACACUUUUUCAGGtt |
| SEQ ID NO: 226 | AAAUAUUUCUUUAAAAGAAtt |
| SEQ ID NO: 227 | AUAUUUCUUUAAAAGAAGGtt |
| SEQ ID NO: 228 | AAGAAGGAUGAACAAUUAUtt |
| SEQ ID NO: 229 | GAAGGAUGAACAAUUAUAUtt |
| SEQ ID NO: 230 | GGAUGAACAAUUAUAUUUAtt |
| SEQ ID NO: 231 | CAAUUAUAUUUAUAUUUCAtt |
| SEQ ID NO: 232 | UUAUAUUUAUAUUUCAGGUtt |
| SEQ ID NO: 233 | UAGUAGAGUUGGCUUUUUUtt |
| SEQ ID NO: 234 | UGACAGUGCUAAAAAAAAAtt |
| SEQ ID NO: 235 | AAAAAAAAGCAUUUUUUUtt |
| SEQ ID NO: 236 | AAAAAAGCAUUUUUUUUUtt |
| SEQ ID NO: 237 | AAAAAGCAUUUUUUUUUAtt |
| SEQ ID NO: 238 | AAAGCAUUUUUUUUUAUGtt |
| SEQ ID NO: 239 | AGCAUUUUUUUUUAUGAUtt |
| SEQ ID NO: 240 | CGUUAUUUGUAAUUUAGUUtt |
| SEQ ID NO: 241 | UUUAGUUUGUAGCUCAUUAtt |
| SEQ ID NO: 242 | AAAAUGUGCCUAGUUUUAtt |
| SEQ ID NO: 243 | AAAUGUGCCUAGUUUUAUtt |
| SEQ ID NO: 244 | AUGUGCCUAGUUUUAUAAAtt |
| SEQ ID NO: 245 | AAAAAAAAAAAAAAACAAtt |
| SEQ ID NO: 246 | AAAAAAAAAAAAACAAAAtt |
| SEQ ID NO: 247 | AAAAAAAAAAACAAAAAAtt |
| SEQ ID NO: 248 | AAAAAAAAACAAAAAAAAtt |
| SEQ ID NO: 249 | AAAAAAACAAAAAAAAAAtt |
| SEQ ID NO: 250 | AAAAAACAAAAAAAAAAAtt |
| SEQ ID NO: 251 | AAAACAAAAAAAAAAAAAtt |
| SEQ ID NO: 252 | CCAGAGGCCCCGCCCCUGCtt |
| SEQ ID NO: 253 | GUUGCCGCCUCCCACCGAGtt |
| SEQ ID NO: 254 | UGGCCAACUUGAAACAAUGtt |
| SEQ ID NO: 255 | UCUUGUCAAUUGGCCAACtt |
| SEQ ID NO: 256 | ACCUCUCGCUCUUGUCAAUtt |
| SEQ ID NO: 257 | CGCAGUAUACCUCUCGCUCtt |
| SEQ ID NO: 258 | CUUUUCCACCUUUUGGAAGtt |
| SEQ ID NO: 259 | CUCCGAUCUUUUCCACCUUtt |
| SEQ ID NO: 260 | CUCUCCGAUCUUUUCCACCtt |
| SEQ ID NO: 261 | ACGUGCCCUCUCCGAUCUUtt |
| SEQ ID NO: 262 | GUACGUGCCCUCUCCGAUCtt |
| SEQ ID NO: 263 | CGUCAACUUGUUUCUGGCUtt |
| SEQ ID NO: 264 | ACCUCUCCCGUCAACUUGUtt |
| SEQ ID NO: 265 | CACCACCUCUCCCGUCAACtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 266 | AGUGUCCAGGCGGAUUUUCtt |
| SEQ ID NO: 267 | CUCAGUGUCCAGGCGGAUUtt |
| SEQ ID NO: 268 | GUCUCAGUGUCCAGGCGGAtt |
| SEQ ID NO: 269 | AUUAGGAUGGUUAAGCUCCtt |
| SEQ ID NO: 270 | CUUGACAAUAUUAGGAUGGtt |
| SEQ ID NO: 271 | AUCCAGCAGCUUGACAAUAtt |
| SEQ ID NO: 272 | GUGAAUGACAUCCAGCAGCtt |
| SEQ ID NO: 273 | AAACCAGGUAGAGUUUAUUtt |
| SEQ ID NO: 274 | AAAAACCAGGUAGAGUUUAtt |
| SEQ ID NO: 275 | UUCAAAACCAGGUAGAGUtt |
| SEQ ID NO: 276 | UGAGAUCUUGGUGCAGAAAtt |
| SEQ ID NO: 277 | CCAUGAAUUUCUUGAGAUCtt |
| SEQ ID NO: 278 | AGAGGCAUCCAUGAAUUUCtt |
| SEQ ID NO: 279 | AGCAGAGGCAUCCAUGAAUtt |
| SEQ ID NO: 280 | CAGCUGGAACAGAUAGCUCtt |
| SEQ ID NO: 281 | AAUAAGCAGAUUCUGAGGUtt |
| SEQ ID NO: 282 | CUCUGUGUUAAUAAGCAGAtt |
| SEQ ID NO: 283 | CUUGAUGGCCCCCUCUGUGtt |
| SEQ ID NO: 284 | UAGUCCAAAGUCUGCUAGCtt |
| SEQ ID NO: 285 | AUUUGCAGCCCAGGAGGAUtt |
| SEQ ID NO: 286 | CACAGCUGUGGAAUAAUAUtt |
| SEQ ID NO: 287 | CCACUUGGGGAAACUUGGCtt |
| SEQ ID NO: 288 | CGGGCCCACUUGGGGAAACtt |
| SEQ ID NO: 289 | AAAAUCUUGCCGGGCCCACtt |
| SEQ ID NO: 290 | GUACAACUUUACUAAAAUCtt |
| SEQ ID NO: 291 | AUCCAGGGGAGGUACAACUtt |
| SEQ ID NO: 292 | AUAACAAGCUCCGUCCAUCtt |
| SEQ ID NO: 293 | UAGGGUCGUAGUGCAGCAUtt |
| SEQ ID NO: 294 | CUUGGCCGAAAUCCGCUUGtt |
| SEQ ID NO: 295 | UGCCUUGGCCGAAAUCCGCtt |
| SEQ ID NO: 296 | AGGGUGAGCCAGGGCUGCCtt |
| SEQ ID NO: 297 | UCGAAGAUGGGGUACUGGCtt |
| SEQ ID NO: 298 | UGAGAUUAGGGCUGGGGCtt |
| SEQ ID NO: 299 | ACUGGAGGAGAGGGUGAGAtt |
| SEQ ID NO: 300 | GGUGAGUGUUUAAGGCAAGtt |
| SEQ ID NO: 301 | AAGACUAGAAGGUGAGUGUtt |
| SEQ ID NO: 302 | CACCCCUGUAUUCCCAGAGtt |
| SEQ ID NO: 303 | CCCCCCUUUCACCCCUGUAtt |
| SEQ ID NO: 304 | UUUUCACUGGUUCCCCCCUtt |
| SEQ ID NO: 305 | UUCCUUUCAUUUUCACUGGtt |
| SEQ ID NO: 306 | ACUGAAACUUCCUUUCAUUtt |
| SEQ ID NO: 307 | AUACUGAAACUUCCUUUCAtt |
| SEQ ID NO: 308 | UCUAAUACUGAAACUUCCUtt |
| SEQ ID NO: 309 | GUGCAUCUAAUACUGAAACtt |
| SEQ ID NO: 310 | AAGGGUGGUGGAGGCUAACtt |
| SEQ ID NO: 311 | UAUUUUUAUACCAACCCUCtt |
| SEQ ID NO: 312 | GGCUUUUUAAAAUUAUUtt |
| SEQ ID NO: 313 | AAGGCUUUUUAAAAUUAUtt |
| SEQ ID NO: 314 | UAGGAAGGCUUUUUUAAAAtt |
| SEQ ID NO: 315 | AACGUGUAGGAAGGCUUUUtt |
| SEQ ID NO: 316 | CUAACGUGUAGGAAGGCUUtt |
| SEQ ID NO: 317 | AUCUAACGUGUAGGAAGGCtt |
| SEQ ID NO: 318 | AUUAUGGGGCAUUCAGAGAtt |
| SEQ ID NO: 319 | AAAUAAUAAUUAUGGGGCAtt |
| SEQ ID NO: 320 | CAAACACUGGAAAUAAUAAtt |
| SEQ ID NO: 321 | CAUUGUGGCAGCAGGAGGCtt |
| SEQ ID NO: 322 | CAUUUGGCCUUUAUAAACAtt |
| SEQ ID NO: 323 | CCCCGCUAUCAUUUGGCCUtt |
| SEQ ID NO: 324 | ACUUAGCCCCCGCUAUCAUtt |
| SEQ ID NO: 325 | GGUUCUCAAAAGCACCAACtt |
| SEQ ID NO: 326 | GUGGUUUUGUUUUACUUGGtt |
| SEQ ID NO: 327 | CCCAGUGGUUUUGUUUUACtt |
| SEQ ID NO: 328 | UCCUCCCAGUGGUUUUGUUtt |
| SEQ ID NO: 329 | ACUCCUCCCAGUGGUUUUGtt |
| SEQ ID NO: 330 | UAGACUCCUCCCAGUGGUUtt |
| SEQ ID NO: 331 | AAUAGACUCCUCCCAGUGGtt |
| SEQ ID NO: 332 | AUUUUUCAACCGAAUUCUtt |
| SEQ ID NO: 333 | AUCUAUUUUUCAACCGAAtt |
| SEQ ID NO: 334 | AACUGAUUGGAUCUAUUUUtt |
| SEQ ID NO: 335 | UAAACUGAUUGGAUCUAUUtt |
| SEQ ID NO: 336 | UAUAAACUGAUUGGAUCUAtt |
| SEQ ID NO: 337 | UAACUAGGUAUAAACUGAtt |
| SEQ ID NO: 338 | UCUUCAGUCUCCCAGCCUAtt |
| SEQ ID NO: 339 | GCCCCACCCGGGCUGAGUCtt |
| SEQ ID NO: 340 | GGACUGGGGCCAAUCAUUUtt |
| SEQ ID NO: 341 | GGGGACUGGGGCCAAUCAUtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 342 | UGUCUCAGGGCCUCCCAGAtt |
| SEQ ID NO: 343 | GCCAUGGUGAAGCAAUAGAtt |
| SEQ ID NO: 344 | ACUAAAAGGAAGAGAAAAAtt |
| SEQ ID NO: 345 | AAAAUGGGAUCAGGGAUCCtt |
| SEQ ID NO: 346 | AUGAUGCCUAAACCCUAACtt |
| SEQ ID NO: 347 | CCCUGAAAAGUGUCAGCAtt |
| SEQ ID NO: 348 | UUCUUUUAAAGAAAUAUUUtt |
| SEQ ID NO: 349 | CCUUCUUUUAAAGAAAUAUtt |
| SEQ ID NO: 350 | AUAAUUGUUCAUCCUUCUUtt |
| SEQ ID NO: 351 | AUAUAAUUGUUCAUCCUUCtt |
| SEQ ID NO: 352 | UAAAUAUAAUUGUUCAUCCtt |
| SEQ ID NO: 353 | UGAAAUAUAAUAUAAUUGtt |
| SEQ ID NO: 354 | ACCUGAAAUAUAAAUAUAAtt |
| SEQ ID NO: 355 | AAAAAAGCCAACUCUACUAtt |
| SEQ ID NO: 356 | UUUUUUUUUAGCACUGUCAtt |
| SEQ ID NO: 357 | AAAAAAAUGCUUUUUUUUUtt |
| SEQ ID NO: 358 | AAAAAAAAUGCUUUUUUUUtt |
| SEQ ID NO: 359 | UAAAAAAAAAUGCUUUUUUtt |
| SEQ ID NO: 360 | CAUAAAAAAAAAUGCUUUtt |
| SEQ ID NO: 361 | AUCAUAAAAAAAAAAUGCUtt |
| SEQ ID NO: 362 | AACUAAAUUACAAAUAACGtt |
| SEQ ID NO: 363 | UAAUGAGCUACAAACUAAAtt |
| SEQ ID NO: 364 | UAAAACUAGGCACAUUUUUtt |
| SEQ ID NO: 365 | UAUAAAACUAGGCACAUUUtt |
| SEQ ID NO: 366 | UUUAUAAAACUAGGCACAUtt |
| SEQ ID NO: 367 | UUGUUUUUUUUUUUUUUUUtt |
| SEQ ID NO: 368 | UUUUGUUUUUUUUUUUUUUtt |
| SEQ ID NO: 369 | UUUUUUGUUUUUUUUUUUUtt |
| SEQ ID NO: 370 | UUUUUUUUGUUUUUUUUUUtt |
| SEQ ID NO: 371 | UUUUUUUUUUGUUUUUUUUtt |
| SEQ ID NO: 372 | UUUUUUUUUUUUGUUUUUUtt |
| SEQ ID NO: 373 | UUUUUUUUUUUUUGUUUUUtt |
| SEQ ID NO: 374 | GCAGGGGCGGGGCCUCUGGtt |
| SEQ ID NO: 375 | CUCGGUGGGAGGCGGCAACtt |
| SEQ ID NO: 376 | CAUUGUUUCAAGUUGGCCAtt |
| SEQ ID NO: 377 | GUUGGCAAAUUGACAAGAtt |
| SEQ ID NO: 378 | AUUGACAAGAGCGAGAGGUtt |
| SEQ ID NO: 379 | GAGCGAGAGGUAUACUGCGtt |
| SEQ ID NO: 380 | CUUCCAAAAGGUGGAAAAGtt |
| SEQ ID NO: 381 | AAGGUGGAAAAGAUCGGAGtt |
| SEQ ID NO: 382 | GGUGGAAAAGAUCGGAGAGtt |
| SEQ ID NO: 383 | AAGAUCGGAGAGGGCACGUtt |
| SEQ ID NO: 384 | GAUCGGAGAGGGCACGUACtt |
| SEQ ID NO: 385 | AGCCAGAAACAAGUUGACGtt |
| SEQ ID NO: 386 | ACAAGUUGACGGGAGAGGUtt |
| SEQ ID NO: 387 | GUUGACGGGAGAGGUGGUGtt |
| SEQ ID NO: 388 | GAAAUCCGCCUGGACACUtt |
| SEQ ID NO: 389 | AAUCCGCCUGGACACUGAGtt |
| SEQ ID NO: 390 | UCCGCCUGGACACUGAGACtt |
| SEQ ID NO: 391 | GGAGCUUAACCAUCCUAAUtt |
| SEQ ID NO: 392 | CCAUCCUAAUAUUGUCAAGtt |
| SEQ ID NO: 393 | UAUUGUCAAGCUGCUGGAUtt |
| SEQ ID NO: 394 | GCUGCUGGAUGUCAUUCACtt |
| SEQ ID NO: 395 | AAUAAACUCUACCUGGUUUtt |
| SEQ ID NO: 396 | UAAACUCUACCUGGUUUUUtt |
| SEQ ID NO: 397 | ACUCUACCUGGUUUUUGAAtt |
| SEQ ID NO: 398 | UUUCUGCACCAAGAUCUCAtt |
| SEQ ID NO: 399 | GAUCUCAAGAAAUUCAUGGtt |
| SEQ ID NO: 400 | GAAAUUCAUGGAUGCCUCUtt |
| SEQ ID NO: 401 | AUUCAUGGAUGCCUCUGCUtt |
| SEQ ID NO: 402 | GAGCUAUCUGUUCCAGCUGtt |
| SEQ ID NO: 403 | ACCUCAGAAUCUGCUUAUUtt |
| SEQ ID NO: 404 | UCUGCUUAUUAACACAGAGtt |
| SEQ ID NO: 405 | CACAGAGGGGGCCAUCAAGtt |
| SEQ ID NO: 406 | GCUAGCAGACUUUGGACUAtt |
| SEQ ID NO: 407 | AUCCUCCGGGCUGCAAAUtt |
| SEQ ID NO: 408 | AUAUUAUUCCACAGCUGUGtt |
| SEQ ID NO: 409 | GCCAAGUUCCCCAAGUGGtt |
| SEQ ID NO: 410 | GUUUCCCCAAGUGGGCCCGtt |
| SEQ ID NO: 411 | GUGGGCCCGGCAAGAUUUUtt |
| SEQ ID NO: 412 | GAUUUUAGUAAAGUUGUACtt |
| SEQ ID NO: 413 | AGUUGUACCUCCCCUGGAUtt |
| SEQ ID NO: 414 | GAUGGACGGAGCUUGUUAUtt |
| SEQ ID NO: 415 | AUGCUGCACUACGACCCUAtt |
| SEQ ID NO: 416 | CAAGCGGAUUUCGGCCAAGtt |
| SEQ ID NO: 417 | GCGGAUUUCGGCCAAGGCAtt |

TABLE 5-continued

Candidate siRNAs for CDK2, SEQ ID NOs: 12-251 are based on NM_052827 and SEQ ID NOs: 252-488 are based on NM_001798.

| | |
|---|---|
| SEQ ID NO: 418 | GGCAGCCCUGGCUCACCCUtt |
| SEQ ID NO: 419 | GCCAGUACCCCAUCUUCGAtt |
| SEQ ID NO: 420 | GCCCCCAGCCCUAAUCUCAtt |
| SEQ ID NO: 421 | UCUCACCCUCUCCUCCAGUtt |
| SEQ ID NO: 422 | CUUGCCUUAAACACUCACCtt |
| SEQ ID NO: 423 | ACACUCACCUUCUAGUCUUtt |
| SEQ ID NO: 424 | CUCUGGGAAUACAGGGGUGtt |
| SEQ ID NO: 425 | UACAGGGGUGAAAGGGGGGtt |
| SEQ ID NO: 426 | AGGGGGGAACCAGUGAAAAtt |
| SEQ ID NO: 427 | CCAGUGAAAAUGAAAGGAAtt |
| SEQ ID NO: 428 | AAUGAAAGGAAGUUUCAGUtt |
| SEQ ID NO: 429 | UGAAAGGAAGUUUCAGUAUtt |
| SEQ ID NO: 430 | AGGAAGUUUCAGUAUUAGAtt |
| SEQ ID NO: 431 | GUUUCAGUAUUAGAUGCACtt |
| SEQ ID NO: 432 | GUUAGCCUCCACCACCCUUtt |
| SEQ ID NO: 433 | GAGGGUUGGUAUAAAAAUAtt |
| SEQ ID NO: 434 | AAAUAAUUUUAAAAAAGCCtt |
| SEQ ID NO: 435 | AUAAUUUUAAAAAAGCCUUtt |
| SEQ ID NO: 436 | UUUUAAAAAGCCUUCCUAtt |
| SEQ ID NO: 437 | AAAAGCCUUCCUACACGUUtt |
| SEQ ID NO: 438 | AAGCCUUCCUACACGUUAGtt |
| SEQ ID NO: 439 | GCCUUCCUACACGUUAGAUtt |
| SEQ ID NO: 440 | UCUCUGAAUGCCCCAUAAUtt |
| SEQ ID NO: 441 | UGCCCCAUAAUUAUUAUUUtt |
| SEQ ID NO: 442 | UUAUUAUUUCCAGUGUUUGtt |
| SEQ ID NO: 443 | GCCUCCUGCUGCCACAAUGtt |
| SEQ ID NO: 444 | UGUUUAUAAAGGCCAAAUGtt |
| SEQ ID NO: 445 | AGGCCAAAUGAUAGCGGGGtt |
| SEQ ID NO: 446 | AUGAUAGCGGGGCUAAGUtt |
| SEQ ID NO: 447 | GUUGGUGCUUUUGAGAACCtt |
| SEQ ID NO: 448 | CCAAGUAAACAAAACCACtt |
| SEQ ID NO: 449 | GUAAACAAAACCACUGGGtt |
| SEQ ID NO: 450 | AACAAACCACUGGGAGGAtt |
| SEQ ID NO: 451 | CAAAACCACUGGGAGGAGUtt |
| SEQ ID NO: 452 | AACCACUGGGAGGAGUCUAtt |
| SEQ ID NO: 453 | CCACUGGGAGGAGUCUAUtt |
| SEQ ID NO: 454 | AGAAUUCGGUUGAAAAAAUtt |
| SEQ ID NO: 455 | UUCGGUUGAAAAAAUAGAUtt |
| SEQ ID NO: 456 | AAAAUAGAUCCAAUCAGUUtt |
| SEQ ID NO: 457 | AAUAGAUCCAAUCAGUUUAtt |
| SEQ ID NO: 458 | UAGAUCCAAUCAGUUUAUtt |
| SEQ ID NO: 459 | UCAGUUUAUACCCUAGUUAtt |
| SEQ ID NO: 460 | UAGGCUGGGAGACUGAAGAtt |
| SEQ ID NO: 461 | GACUCAGCCCGGGUGGGCtt |
| SEQ ID NO: 462 | AAAUGAUUGGCCCCAGUCCtt |
| SEQ ID NO: 463 | AUGAUUGGCCCCAGUCCCtt |
| SEQ ID NO: 464 | UCUGGGAGGCCCUGAGACAtt |
| SEQ ID NO: 465 | UCUAUUGCUUCACCAUGGCtt |
| SEQ ID NO: 466 | UUUUUCUCUUCCUUUUAGUtt |
| SEQ ID NO: 467 | GGAUCCCUGAUCCCAUUUUtt |
| SEQ ID NO: 468 | GUUAGGGUUUAGGCAUCAtt |
| SEQ ID NO: 469 | UGCUGACACUUUUUCAGGGtt |
| SEQ ID NO: 470 | AAAUAUUCUUUAAAAGAAtt |
| SEQ ID NO: 471 | AUAUUUCUUUAAAAGAAGGtt |
| SEQ ID NO: 472 | AAGAAGGAUGAACAAUUAUtt |
| SEQ ID NO: 473 | GAAGGAUGAACAAUUAUAUtt |
| SEQ ID NO: 474 | GGAUGAACAAUUAUAUUUAtt |
| SEQ ID NO: 475 | CAAUUAUAUUUAUAUUUCAtt |
| SEQ ID NO: 476 | UUAUAUUUAUAUUUCAGGUtt |
| SEQ ID NO: 477 | UAGUAGAGUUGGCUUUUUtt |
| SEQ ID NO: 478 | UGACAGUGCUAAAAAAAAAtt |
| SEQ ID NO: 479 | AAAAAAAAGCAUUUUUUUtt |
| SEQ ID NO: 480 | AAAAAAGCAUUUUUUUUUtt |
| SEQ ID NO: 481 | AAAAAGCAUUUUUUUUUAtt |
| SEQ ID NO: 482 | AAAGCAUUUUUUUUUAUGtt |
| SEQ ID NO: 483 | AGCAUUUUUUUUUAUGAtt |
| SEQ ID NO: 484 | CGUUAUUUGUAAUUUAGUUtt |
| SEQ ID NO: 485 | UUUAGUUUGUAGCUCAUUAtt |
| SEQ ID NO: 486 | AAAAAUGCCUAGUUUUAtt |
| SEQ ID NO: 487 | AAAUGUGCCUAGUUUUAUtt |
| SEQ ID NO: 488 | AUGUGCCUAGUUUUAUAAAtt |

TABLE 6

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 489 | CGGCAGCGGAGGUUGCAAAtt |
| SEQ ID NO: 490 | GCGGCGACGGCAGCGGAGGtt |
| SEQ ID NO: 491 | CACCUGAACCGCUGGCGAAtt |
| SEQ ID NO: 492 | CAGCACCUGCAGAGCGUCGtt |
| SEQ ID NO: 493 | AGGACACACUGCCUGAGAGtt |
| SEQ ID NO: 494 | GCCGGUCACACUCAGGCCAtt |
| SEQ ID NO: 495 | GUACAGUGUCUGGUAUUGGtt |
| SEQ ID NO: 496 | GCUUGUACAGUGUCUGGUAtt |
| SEQ ID NO: 497 | CUCACACCUCUCGUAGAGCtt |
| SEQ ID NO: 498 | CGUGAGCACAAUCUCAAGGtt |
| SEQ ID NO: 499 | CAGGAAGGAGAGGUCGGCAtt |
| SEQ ID NO: 500 | CGAGGACAUAGCCUGUCACtt |
| SEQ ID NO: 501 | UGGUAGAGUAGAGAAUUCAtt |
| SEQ ID NO: 502 | GCAAUGGUAGAGUAGAGAAtt |
| SEQ ID NO: 503 | CCCUCGCACCACGCGGAGGtt |
| SEQ ID NO: 504 | CAUGACGAAGAUGGCAAACtt |
| SEQ ID NO: 505 | GCUGGAGUUGGUGUUAUAGtt |
| SEQ ID NO: 506 | AGCGUGGCUGGAGUUGGUGtt |
| SEQ ID NO: 507 | GCGCAGAGCGUGGCUGGAGtt |
| SEQ ID NO: 508 | CAUCAAGGAGGUACCAGUCtt |
| SEQ ID NO: 509 | GCACUUAGAGUGAGCAGUCtt |
| SEQ ID NO: 510 | GGCACCUUGGAAGAGGCACtt |
| SEQ ID NO: 511 | GGCCAAGGUGACAGGCACCtt |
| SEQ ID NO: 512 | CUUAGGGAGCAAUGGACCUtt |
| SEQ ID NO: 513 | ACUGGGGGCCCUCUAUUGCtt |
| SEQ ID NO: 514 | CCCUACUGGGGGCCCUCUAtt |
| SEQ ID NO: 515 | ACAAGGACACAGGGUUCCUtt |
| SEQ ID NO: 516 | GCCCCACAAGGACACAGGGtt |
| SEQ ID NO: 517 | UUUGAAAUUAGAAAAACGGtt |
| SEQ ID NO: 518 | GGUACACUGUACUUUGAAAtt |
| SEQ ID NO: 519 | GCCUCCGGUACACUGUACUtt |
| SEQ ID NO: 520 | GCCUCCCAAAAUGCUGGGAtt |
| SEQ ID NO: 521 | CUCAAGUGAUCUGCCCUCCtt |
| SEQ ID NO: 522 | GAGACAGGGUUUCGCCAUGtt |
| SEQ ID NO: 523 | UUUUAGUAGAGACAGGGUtt |
| SEQ ID NO: 524 | AUUUUAUUUUUUGUAUUUtt |
| SEQ ID NO: 525 | UUAUUUUAUUUUUUGUAUtt |
| SEQ ID NO: 526 | UUUAUUUUAUUUUAUUUUUtt |

TABLE 6-continued

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 527 | UUUUUAUUUUAUUUUAUUUtt |
| SEQ ID NO: 528 | AUUUUUAUUUUAUUUUAUtt |
| SEQ ID NO: 529 | UUUGCAACCUCCGCUGCCGtt |
| SEQ ID NO: 530 | CCUCCGCUGCCGUCGCCGCtt |
| SEQ ID NO: 531 | UUCGCCAGCGGUUCAGGUGtt |
| SEQ ID NO: 532 | CGACGCUCUGCAGGUGCUGtt |
| SEQ ID NO: 533 | CUCUCAGGCAGUGUGUCCUtt |
| SEQ ID NO: 534 | UGGCCUGAGUGUGACCGGCtt |
| SEQ ID NO: 535 | CCAAUACCAGACACUGUACtt |
| SEQ ID NO: 536 | UACCAGACACUGUACAAGCtt |
| SEQ ID NO: 537 | GCUCUACGAGAGGUGUGAGtt |
| SEQ ID NO: 538 | CCUUGAGAUUGUGCUCACGtt |
| SEQ ID NO: 539 | UGCCGACCUCUCCUUCCUGtt |
| SEQ ID NO: 540 | GUGACAGGCUAUGUCCUCGtt |
| SEQ ID NO: 541 | UGAAUUCUCUACUCUACCAtt |
| SEQ ID NO: 542 | UUCUCUACUCUACCAUUGCtt |
| SEQ ID NO: 543 | CCUCCGCGUGGUGCGAGGGtt |
| SEQ ID NO: 544 | GUUUGCCAUCUUCGUCAUGtt |
| SEQ ID NO: 545 | CUAUAACACCAACUCCAGCtt |
| SEQ ID NO: 546 | CACCAACUCCAGCCACGCUtt |
| SEQ ID NO: 547 | CUCCAGCCACGCUCUGCGCtt |
| SEQ ID NO: 548 | GACUGGUACCUCCUUGAUGtt |
| SEQ ID NO: 549 | GACUGCUCACUCUAAGUGCtt |
| SEQ ID NO: 550 | GUGCCUCUUCCAAGGUGCCtt |
| SEQ ID NO: 551 | GGUGCCUGUCACCUUGGCCtt |
| SEQ ID NO: 552 | AGGUCCAUUGCUCCCUAAGtt |
| SEQ ID NO: 553 | GCAAUAGAGGGCCCCCAGUtt |
| SEQ ID NO: 554 | UAGAGGGCCCCCAGUAGGGtt |
| SEQ ID NO: 555 | AGGAACCCUGUGUCCUUGUtt |
| SEQ ID NO: 556 | CCCUGUGUCCUUGUGGGGCtt |
| SEQ ID NO: 557 | CCGUUUUCUAAUUUCAAAtt |
| SEQ ID NO: 558 | UUUCAAAGUACAGUGUACCtt |
| SEQ ID NO: 559 | AGUACAGUGUACCGGAGGCtt |
| SEQ ID NO: 560 | UCCCAGCAUUUUGGGAGGCtt |
| SEQ ID NO: 561 | GGAGGGCAGAUCACUUGAGtt |
| SEQ ID NO: 562 | CAUGGCGAAACCCUGUCUCtt |
| SEQ ID NO: 563 | ACCCUGUCUCUACUAAAAtt |
| SEQ ID NO: 564 | AAAUACAAAAAAUAAAAUtt |

TABLE 6-continued

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 565 | AUACAAAAAAUAAAAUAAtt |
| SEQ ID NO: 566 | AAAAAUAAAAUAAAAUAAAtt |
| SEQ ID NO: 567 | AAAUAAAAUAAAAUAAAAtt |
| SEQ ID NO: 568 | AUAAAAUAAAAUAAAAAAUtt |
| SEQ ID NO: 569 | CGGCAGCGGAGGUUGCAAAtt |
| SEQ ID NO: 570 | GCGGCGACGGCAGCGGAGGtt |
| SEQ ID NO: 571 | CACCUGAACCGCUGGCGAAtt |
| SEQ ID NO: 572 | CAGCACCUGCAGAGCGUCGtt |
| SEQ ID NO: 573 | AGGACACACUGCCUGAGAGtt |
| SEQ ID NO: 574 | GCCGGUCACACUCAGGCCAtt |
| SEQ ID NO: 575 | GUACAGUGUCUGGUAUUGGtt |
| SEQ ID NO: 576 | GCUUGUACAGUGUCUGGUAtt |
| SEQ ID NO: 577 | CUCACACCUCUCGUAGAGCtt |
| SEQ ID NO: 578 | CGUGAGCACAAUCUCAAGGtt |
| SEQ ID NO: 579 | CAGGAAGGAGAGGUCGGCAtt |
| SEQ ID NO: 580 | CGAGGACAUAGCCUGUCACtt |
| SEQ ID NO: 581 | UGGUAGAGUAGAGAAUUCAtt |
| SEQ ID NO: 582 | GCAAUGGUAGAGUAGAGAAtt |
| SEQ ID NO: 583 | CCCUCGCACCACGCGGAGGtt |
| SEQ ID NO: 584 | CAUGACGAAGAUGGCAAACtt |
| SEQ ID NO: 585 | GCUGGAGUUGGUGUUAUAGtt |
| SEQ ID NO: 586 | AGCGUGGCUGGAGUUGGUGtt |
| SEQ ID NO: 587 | GCGCAGAGCGUGGCUGGAGtt |
| SEQ ID NO: 588 | GUGACAAAGCUUAUCGUUCtt |
| SEQ ID NO: 589 | CAUGUGACAAAGCUUAUCGtt |
| SEQ ID NO: 590 | UGUGUCCAUGUGACAAAGCtt |
| SEQ ID NO: 591 | ACGAUGUCCCUCCAGUCAAtt |
| SEQ ID NO: 592 | ACAGCUUCUGCCAUUGUCCtt |
| SEQ ID NO: 593 | GGGGGGACAGCUUCUGCCAtt |
| SEQ ID NO: 594 | UCAUGACAGGGGGGACAGCtt |
| SEQ ID NO: 595 | AGGACCCCAGCAUCGCCCCtt |
| SEQ ID NO: 596 | UGGUCAAUGUCUGGCAGUCtt |
| SEQ ID NO: 597 | CUGAGGAGCACAGAUGGUCtt |
| SEQ ID NO: 598 | GGGCCCAAAGCAGUGACCAtt |
| SEQ ID NO: 599 | AUGGCAGCACUGGUUGGGGtt |
| SEQ ID NO: 600 | CUCAUCAUGGCAGCACUGGtt |
| SEQ ID NO: 601 | UACACAGGCUCCACUGUCAtt |
| SEQ ID NO: 602 | CAGCUGGAAAGUUAGCUUGtt |
| SEQ ID NO: 603 | UUCCAGCUGGAAAGUUAGCtt |
| SEQ ID NO: 604 | UUGGGUUCCAGCUGGAAAGtt |
| SEQ ID NO: 605 | ACUUGGUGUGGGGAUUGGGtt |
| SEQ ID NO: 606 | CUGAUACUUGGUGUGGGGAtt |
| SEQ ID NO: 607 | AACUCCUCCAUACUGAUACtt |
| SEQ ID NO: 608 | UGUUUGAUCCACCACAAAGtt |
| SEQ ID NO: 609 | AGGCCCUGACACAGGAUGUtt |
| SEQ ID NO: 610 | AUUUUUAUCUACUUCCAUCtt |
| SEQ ID NO: 611 | UGAGCCCAUUUUUAUCUACtt |
| SEQ ID NO: 612 | ACACAUCUUGAGCCCAUUUtt |
| SEQ ID NO: 613 | UCACACAUCUUGAGCCCAUtt |
| SEQ ID NO: 614 | CCCACAAGGCUCACACAUCtt |
| SEQ ID NO: 615 | GCCUGUUCCCUCACAGGCUtt |
| SEQ ID NO: 616 | AAGCGGCUCCCAGAGCCUGtt |
| SEQ ID NO: 617 | GUUCACAAAUCCAUCAAUGtt |
| SEQ ID NO: 618 | GCCCAGGAUCUUGGUGCAGtt |
| SEQ ID NO: 619 | GUCCAGGUUGCCCAGGAUCtt |
| SEQ ID NO: 620 | GGUGAUCAGAAAGUCCAGGtt |
| SEQ ID NO: 621 | CUUGUGCCAGGGGUCUCCAtt |
| SEQ ID NO: 622 | UGGGUCCAGGGCAGGGAUCtt |
| SEQ ID NO: 623 | UGUCCGGAAGACAUUGAGCtt |
| SEQ ID NO: 624 | CCGUACUGUCCGGAAGACAtt |
| SEQ ID NO: 625 | GGGCGGCCAGGACUGGAUGtt |
| SEQ ID NO: 626 | AUUGGAAAAACACUGAAGtt |
| SEQ ID NO: 627 | GCCUCCAAUGGUUGUCAAAtt |
| SEQ ID NO: 628 | AGGCUUCUGCCUCCAAUGGtt |
| SEQ ID NO: 629 | AAGCCCCGGUUGUAGAGGCtt |
| SEQ ID NO: 630 | CAACAAUGAGAAGCCCCGGtt |
| SEQ ID NO: 631 | AGAUGUGACAUUCAAGUUCtt |
| SEQ ID NO: 632 | CAGAGAUGUGACAUUCAAGtt |
| SEQ ID NO: 633 | GAAGCCCAGAGAUGUGACAtt |
| SEQ ID NO: 634 | ACGCCCAGCACUAAUUCCtt |
| SEQ ID NO: 635 | AGAUACGCCCAGCACUAAUtt |
| SEQ ID NO: 636 | CAGAGCUGCCUAUUGGCACtt |
| SEQ ID NO: 637 | GUGGUAGCAGAGCUGCCUAtt |
| SEQ ID NO: 638 | CCGAAGCACCUUGGUCCAGtt |
| SEQ ID NO: 639 | CGUAGGCCCCGAAGCACCtt |
| SEQ ID NO: 640 | GCUUGAUGUCUAGUCGCUCtt |

TABLE 6-continued

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 641 | UCUGCGCGGCCGAUUAUGCtt |
| SEQ ID NO: 642 | GCAGUCUCUGCGCGGCCGAtt |
| SEQ ID NO: 643 | GCACAGUGGGUCACACACUtt |
| SEQ ID NO: 644 | ACACCUCCUCGGCUAUAAUtt |
| SEQ ID NO: 645 | AGGCUCCCCAUUCAGAAAGtt |
| SEQ ID NO: 646 | AAAUUCUCGAGGCUCCCCAtt |
| SEQ ID NO: 647 | AUUCGGCCUCAUGGGCAAAtt |
| SEQ ID NO: 648 | CCGGGUGGCAGGAGAAGCAtt |
| SEQ ID NO: 649 | UGCCCUCCAUGGGUUGGCAtt |
| SEQ ID NO: 650 | UGGCAGUGCCCUCCAUGGGtt |
| SEQ ID NO: 651 | AGUAUCAGAGCCCGAGCCAtt |
| SEQ ID NO: 652 | CAUCUCGAAAAUGGGCACAtt |
| SEQ ID NO: 653 | GUACUUGUAGAUUGGGCCCtt |
| SEQ ID NO: 654 | ACAUCUGGGUACUUGUAGAtt |
| SEQ ID NO: 655 | AUUCUGAACAUCUGGGUACtt |
| SEQ ID NO: 656 | AUGGCAGGGCCGACAUUCAtt |
| SEQ ID NO: 657 | UCUCAUGGCAGGGCCGACAtt |
| SEQ ID NO: 658 | UUUACACCCUGGGUGCAGtt |
| SEQ ID NO: 659 | GUCUUGAAGCUCUGGUCCUtt |
| SEQ ID NO: 660 | GUGUUUGUCCUAAACAGUCtt |
| SEQ ID NO: 661 | UGCCGAUCAGCACCAGUGUtt |
| SEQ ID NO: 662 | AGCCAUUGUCAGAUGGGUUtt |
| SEQ ID NO: 663 | AAAGCCAUUGUCAGAUGGGtt |
| SEQ ID NO: 664 | GCUAUCACUGUCAAAGCCAtt |
| SEQ ID NO: 665 | UCGCCUCAUAGCCCUUUUAtt |
| SEQ ID NO: 666 | GUAUCGCCUCAUAGCCCUUtt |
| SEQ ID NO: 667 | AAGUAUCGCCUCAUAGCCCtt |
| SEQ ID NO: 668 | GCUCUAUGCUCUCACCCCGtt |
| SEQ ID NO: 669 | GGCCAAGACUUUGUUAGCCtt |
| SEQ ID NO: 670 | GAUUCUGGCCAAGACUUUGtt |
| SEQ ID NO: 671 | GAAGAUUCUGGCCAAGACUtt |
| SEQ ID NO: 672 | AGCUCUGUCUCUUUGAAGAtt |
| SEQ ID NO: 673 | CUUCCUUAGCUCUGUCUCUtt |
| SEQ ID NO: 674 | CCAAGCACUUUAAGCUUCCtt |
| SEQ ID NO: 675 | CGAGCCAAGCACUUUAAGCtt |
| SEQ ID NO: 676 | GACACCCGAGCCAAGCACUtt |
| SEQ ID NO: 677 | CACACUCCUUUGUGCACAGtt |
| SEQ ID NO: 678 | CUCAGGGAUCCACACUCCUtt |
| SEQ ID NO: 679 | AGACUGGAAUCUUGAUUGAtt |
| SEQ ID NO: 680 | AUGCAGACUGGAAUCUUGAtt |
| SEQ ID NO: 681 | UUUAAUGCAGACUGGAAUCtt |
| SEQ ID NO: 682 | ACUCUUGUCCUCAAUGACUtt |
| SEQ ID NO: 683 | AAAACUCUGCCGUCCACUCtt |
| SEQ ID NO: 684 | GCAUGAUCUGUCACAGCtt |
| SEQ ID NO: 685 | GGGCAUAGUCCCAGCAGCCtt |
| SEQ ID NO: 686 | GAGAACCCAGAGGCAAAUtt |
| SEQ ID NO: 687 | GCCCCAGUGCCCCCCGGUGtt |
| SEQ ID NO: 688 | GGCAAUUUGUACUCCCAGtt |
| SEQ ID NO: 689 | AGUACAUUCCCUUGGCAAUtt |
| SEQ ID NO: 690 | CUCAAGGUAGUACAUUCCCtt |
| SEQ ID NO: 691 | UGUUCCUCAAGGUAGUACAtt |
| SEQ ID NO: 692 | UUCUAUGCACCAUACCAUGtt |
| SEQ ID NO: 693 | ACGUUUCGGGCAGCCAGGUtt |
| SEQ ID NO: 694 | GGUGACUUGAGUAGCACGUtt |
| SEQ ID NO: 695 | CUGAACCUGACUGGGUGACtt |
| SEQ ID NO: 696 | CUCACUGUAUAGCAGCUGCtt |
| SEQ ID NO: 697 | CAUCCACUUAAUUGGAGUCtt |
| SEQ ID NO: 698 | UCAAGGGCCAUCCACUUAAtt |
| SEQ ID NO: 699 | ACUCUCAAGGGCCAUCCACtt |
| SEQ ID NO: 700 | AUCACUCUGGUGUGUGUAUtt |
| SEQ ID NO: 701 | UCUCUAGCAGGUCUGGUACtt |
| SEQ ID NO: 702 | CUGUGCCAACCGCUCCCCCtt |
| SEQ ID NO: 703 | AUCACCAUGUAGACAUCAAtt |
| SEQ ID NO: 704 | CUCAUCAAUCAUCCAACACtt |
| SEQ ID NO: 705 | UUUAAAGGUUGGGCGAAUGtt |
| SEQ ID NO: 706 | UUGGCUAGUUCUUUAAAGGtt |
| SEQ ID NO: 707 | GAACUCAUUGGCUAGUUCUtt |
| SEQ ID NO: 708 | UGGUGAACUCAUUGGCUAGtt |
| SEQ ID NO: 709 | GGCCAUCCUGGUGAACUCAtt |
| SEQ ID NO: 710 | CCAGGCCCACUCUCUCUCUtt |
| SEQ ID NO: 711 | GGCUCUGGCCCAGGGGCUAtt |
| SEQ ID NO: 712 | ACUUCCUCUAGCUUCUUGUtt |
| SEQ ID NO: 713 | CUCUACUUCCUCUAGCUUCtt |
| SEQ ID NO: 714 | CAGCUCUACUUCCUCUAGCtt |
| SEQ ID NO: 715 | GUUCUGGCUCCAGCUCUACtt |
| SEQ ID NO: 716 | AGUCUAGGUCUAGGUCUAGtt |

TABLE 6-continued

Candidate siRNAs for ERBB3, SEQ ID NOs: 489-568 are based on NM_001005915 and SEQ ID NOs: 569-1120 are based on NM_001982.

| SEQ ID NO | Sequence |
|---|---|
| SEQ ID NO: 717 | CCAGGUUGUCCUCCUCUGCtt |
| SEQ ID NO: 718 | CAGUGUGGUGGUUGCCAGGtt |
| SEQ ID NO: 719 | GCGGAGCCCAGUGUGGUGGtt |
| SEQ ID NO: 720 | CCACGUGGCCGAUUAAGUGtt |
| SEQ ID NO: 721 | CUGGCUCCCACGUGGCCGAtt |
| SEQ ID NO: 722 | AUGUAUCCAGAUGAUGGACtt |
| SEQ ID NO: 723 | CUCCCCAAGAUUACCCUGGtt |
| SEQ ID NO: 724 | CUGGCAAGACUCCCCAAGAtt |
| SEQ ID NO: 725 | AGACUGGACGGGGGCACCGtt |
| SEQ ID NO: 726 | GCCAGGCAUCCCCGUGGCAtt |
| SEQ ID NO: 727 | AGCUCAGCCUCAGAGCCUGtt |
| SEQ ID NO: 728 | GCUCCUACACAUUGACACUtt |
| SEQ ID NO: 729 | CUGCUCCGGCUCCUACACAtt |
| SEQ ID NO: 730 | CAUAACCGUUGACAUCCUCtt |
| SEQ ID NO: 731 | AUCUGGCAUGACAUAACCGtt |
| SEQ ID NO: 732 | CCGGGAGGAGGGAGUACCUtt |
| SEQ ID NO: 733 | CCACUGAAGAAAGGGUGCCtt |
| SEQ ID NO: 734 | CCUCAUCUUCAUCUUCUUCtt |
| SEQ ID NO: 735 | ACUCCUCAUCUUCAUCUUCtt |
| SEQ ID NO: 736 | CAUACUCCUCAUCUUCAUCtt |
| SEQ ID NO: 737 | UGUAUUCAUACUCCUCAUCtt |
| SEQ ID NO: 738 | UUCUCCUCCGGUUCAUGUAtt |
| SEQ ID NO: 739 | ACUGUGCCUUCUCCUCCGGtt |
| SEQ ID NO: 740 | GGAUGAGGUGGACUGUGCCtt |
| SEQ ID NO: 741 | CCCAGCUCCUCAAGGGAACtt |
| SEQ ID NO: 742 | UCAUAGUCUUCAUCUGGAGtt |
| SEQ ID NO: 743 | GAUUCAUAUAUUCAUAGUCtt |
| SEQ ID NO: 744 | CUCGUUGCCGAUUCAUAUAtt |
| SEQ ID NO: 745 | ACCUCCAUCUCGUUGCCGAtt |
| SEQ ID NO: 746 | CAGGACCACCUCCAUCUCGtt |
| SEQ ID NO: 747 | CUCUCAUCUCUUCAUACCCtt |
| SEQ ID NO: 748 | CCUGAAAAGCUCUCAUCUCtt |
| SEQ ID NO: 749 | UCUAAGCUACGUAGAGUUUtt |
| SEQ ID NO: 750 | CCUCUAAGCUACGUAGAGUtt |
| SEQ ID NO: 751 | GCUAUGCCAGUAAUCAGGGtt |
| SEQ ID NO: 752 | CGUUCUCUGGGCAUUAGCCtt |
| SEQ ID NO: 753 | GAGUUACGUUCUCUGGGCAtt |
| SEQ ID NO: 754 | ACAGGGAGCAGGAGUUACGtt |
| SEQ ID NO: 755 | GUGCCACAGGGAGCAGGAGtt |
| SEQ ID NO: 756 | CUAAAGGCACUAGCUGCCAtt |
| SEQ ID NO: 757 | CUCCAAAGAUUGAAUGGAAtt |
| SEQ ID NO: 758 | GUUUAAAAGCCUCCAAAGAtt |
| SEQ ID NO: 759 | GAAUUUGUGUCAAAAUGUtt |
| SEQ ID NO: 760 | GCUACAUACCAUAAGAAUUtt |
| SEQ ID NO: 761 | UGGCUACAUACCAUAAGAAtt |
| SEQ ID NO: 762 | AGGAAAACCUUUCCUGGGGtt |
| SEQ ID NO: 763 | CACAAAAUAAGGAAAACCUtt |
| SEQ ID NO: 764 | GGGAUAUGGAGAGUAAUCCtt |
| SEQ ID NO: 765 | GGCACACAUAAGAGCCUAGtt |
| SEQ ID NO: 766 | UUUCCUCCCUUUCCUCUUCtt |
| SEQ ID NO: 767 | AGGUUUCCUCCCUUUCCUCtt |
| SEQ ID NO: 768 | UCUGCUAGGUUUCCUCCCUtt |
| SEQ ID NO: 769 | ACACUUCCUCUGCUAGGUtt |
| SEQ ID NO: 770 | CAUAAACCAAAAUUACACUtt |
| SEQ ID NO: 771 | UAAGAGUCAUAAACCAAAAtt |
| SEQ ID NO: 772 | CUUCUGUCUUUCUAGGGGtt |
| SEQ ID NO: 773 | AGAUUUAAGCUUCUGUCUtt |
| SEQ ID NO: 774 | UUCUUCACAGAUUUUAAGCtt |
| SEQ ID NO: 775 | ACCUCUUUCUUCACAGAUUtt |
| SEQ ID NO: 776 | UAACCUCUUUCUUCACAGAtt |
| SEQ ID NO: 777 | UCUACUCCUAACCUCUUUCtt |
| SEQ ID NO: 778 | AUAUCUACUCCUAACCUCUtt |
| SEQ ID NO: 779 | CUCAUAGUUAAGUGCUGAAtt |
| SEQ ID NO: 780 | UAUGAUGCCUGGCUCAUAGtt |
| SEQ ID NO: 781 | GAGAUAAUGUAGGUGAAGUtt |
| SEQ ID NO: 782 | UGUAUGUCACAGAAUUGUUtt |
| SEQ ID NO: 783 | UAUGUAUGUCACAGAAUUGtt |
| SEQ ID NO: 784 | UAAUAUGUAUGUCACAGAAtt |
| SEQ ID NO: 785 | CACCAUGCCCGACUUCCCUtt |
| SEQ ID NO: 786 | AUGAGCCACCAUGCCCGACtt |
| SEQ ID NO: 787 | GCCUCCAAAGUGCUGAGAtt |
| SEQ ID NO: 788 | UCCUUGCCUCAGGUAAUCCtt |
| SEQ ID NO: 789 | UAAGCUGGUCUCAAACUCCtt |
| SEQ ID NO: 790 | AGAUGGGGUCUUACUAUGtt |
| SEQ ID NO: 791 | UUUUAAAGAGAUGGGGUCUtt |
| SEQ ID NO: 792 | UUUUUUUUUUUUUUUUUUUtt |

TABLE 6-continued

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 793 | GUUUUUUUUUUUUUUUUUtt |
| SEQ ID NO: 794 | AAGUUUUUUUUUUUUUUUtt |
| SEQ ID NO: 795 | UAAAGUUUUUUUUUUUUUtt |
| SEQ ID NO: 796 | UCUAAAGUUUUUUUUUUUtt |
| SEQ ID NO: 797 | GUUCUAAAGUUUUUUUUUtt |
| SEQ ID NO: 798 | CAGUUCUAAAGUUUUUUUtt |
| SEQ ID NO: 799 | CCCAGUUCUAAAGUUUUUtt |
| SEQ ID NO: 800 | CACCCAGUUCUAAAGUUUtt |
| SEQ ID NO: 801 | UGCACCCAGUUCUAAAGUtt |
| SEQ ID NO: 802 | ACUGCACCCAGUUCUAAAGtt |
| SEQ ID NO: 803 | CAUGAGCCACUGCACCCAGtt |
| SEQ ID NO: 804 | CCCAAAGUGCUGGCUGGGAtt |
| SEQ ID NO: 805 | AUUCUGGGCUCAAGUGAUCtt |
| SEQ ID NO: 806 | UCCAUAGGCUUAUCUCUAAtt |
| SEQ ID NO: 807 | UUGCUAUGUUUCCAUAGGCtt |
| SEQ ID NO: 808 | AGACAGUGUCUUGCUAUGUtt |
| SEQ ID NO: 809 | CCCCUGUAGAGACAGUGUCtt |
| SEQ ID NO: 810 | CUCAGUUUCUUUUUUUUUtt |
| SEQ ID NO: 811 | GGCUCAGUUUCUUUUUUUUtt |
| SEQ ID NO: 812 | AAGGCUCAGUUUCUUUUUUtt |
| SEQ ID NO: 813 | UUAAGGCUCAGUUUCUUUUtt |
| SEQ ID NO: 814 | CUUUAAGGCUCAGUUUCUUtt |
| SEQ ID NO: 815 | CUCUUUAAGGCUCAGUUUCtt |
| SEQ ID NO: 816 | CAUCUCUUUAAGGCUCAGUtt |
| SEQ ID NO: 817 | CUUAAUUUAUUUCAUCUCUtt |
| SEQ ID NO: 818 | GAUCUACUGCUUAAUUUAUtt |
| SEQ ID NO: 819 | CCUGGAUCUACUGCUUAAUtt |
| SEQ ID NO: 820 | UGCAUCCUGGAUCUACUGCtt |
| SEQ ID NO: 821 | CACAGGAAUUGGGAGGAUUtt |
| SEQ ID NO: 822 | UGCACAGGAAUUGGGAGGAtt |
| SEQ ID NO: 823 | AAGAGCACAUGCACAGGAAtt |
| SEQ ID NO: 824 | AUCAGUUUUCUUGGCACCtt |
| SEQ ID NO: 825 | UAACUUAAAUCAGUUUUCtt |
| SEQ ID NO: 826 | CUGUAACUUAAAUCAGUUUtt |
| SEQ ID NO: 827 | GGCUGUAACUUAAAUCAGUtt |
| SEQ ID NO: 828 | CUUAAACAAGGGCUGUAACtt |
| SEQ ID NO: 829 | AAACAAGAAACAGUGCCCCtt |
| SEQ ID NO: 830 | CUGUUGGGGUUAGACUUGAtt |
| SEQ ID NO: 831 | GUGGCUGUUGGGGUUAGACtt |
| SEQ ID NO: 832 | GAGGAUGUGGCUGUUGGGGtt |
| SEQ ID NO: 833 | GUAUAGGAGGAUGUGGCUGtt |
| SEQ ID NO: 834 | UGACUACCCCACCACCACtt |
| SEQ ID NO: 835 | GAUGUCCAGUUAUUUUCCtt |
| SEQ ID NO: 836 | CAAAGAUGUCCAGUUAUUUtt |
| SEQ ID NO: 837 | CACAAAGAUGUCCAGUUAUtt |
| SEQ ID NO: 838 | UUUACACAAAGAUGUCCAGtt |
| SEQ ID NO: 839 | GGCACAUGUGGAUUAUGGUtt |
| SEQ ID NO: 840 | CAUUUACGGCACAUGUGGAtt |
| SEQ ID NO: 841 | GAUAAGGAGUGAAGAUCAUtt |
| SEQ ID NO: 842 | CUUGGGGAUCCUUGUGAAUtt |
| SEQ ID NO: 843 | AAGUGGAUCUUGGGGAUCCtt |
| SEQ ID NO: 844 | UGGCUUCUAAAAGUGGAUCtt |
| SEQ ID NO: 845 | UUUGCAACCUCCGCUGCCGtt |
| SEQ ID NO: 846 | CCUCCGCUGCCGUCGCCGCtt |
| SEQ ID NO: 847 | UUCGCCAGCGGUUCAGGUGtt |
| SEQ ID NO: 848 | CGACGCUCUGCAGGUGCUGtt |
| SEQ ID NO: 849 | CUCUCAGGCAGUGUGUCCUtt |
| SEQ ID NO: 850 | UGGCCUGAGUGUGACCGGCtt |
| SEQ ID NO: 851 | CCAAUACCAGACACUGUACtt |
| SEQ ID NO: 852 | UACCAGACACUGUACAAGCtt |
| SEQ ID NO: 853 | GCUCUACGAGAGGUGUGAGtt |
| SEQ ID NO: 854 | CCUUGAGAUUGUGCUCACGtt |
| SEQ ID NO: 855 | UGCCGACCUCUCCUUCCUGtt |
| SEQ ID NO: 856 | GUGACAGGCUAUGUCCUCGtt |
| SEQ ID NO: 857 | UGAAUUCUCUACUCUACCAtt |
| SEQ ID NO: 858 | UUCUCUACUCUACCAUUGCtt |
| SEQ ID NO: 859 | CCUCCGCGUGGUGCGAGGGtt |
| SEQ ID NO: 860 | GUUUGCCAUCUUCGUCAUGtt |
| SEQ ID NO: 861 | CUAUAACACCAACUCCAGCtt |
| SEQ ID NO: 862 | CACCAACUCCAGCCACGCUtt |
| SEQ ID NO: 863 | CUCCAGCCACGCUCUGCGCtt |
| SEQ ID NO: 864 | GAACGAUAAGCUUUGUCACtt |
| SEQ ID NO: 865 | CGAUAAGCUUUGUCACAUGtt |
| SEQ ID NO: 866 | GCUUUGUCACAUGGACACAtt |
| SEQ ID NO: 867 | UUGACUGGAGGGACAUCGUtt |
| SEQ ID NO: 868 | GGACAAUGGCAGAAGCUGUtt |

TABLE 6-continued

Candidate siRNAs for ERBB3, SEQ ID NOs: 489-568 are based on NM_001005915 and SEQ ID NOs: 569-1120 are based on NM_001982.

| SEQ ID NO: | Sequence |
|---|---|
| SEQ ID NO: 869 | UGGCAGAAGCUGUCCCCCCUtt |
| SEQ ID NO: 870 | GCUGUCCCCCCUGUCAUGAtt |
| SEQ ID NO: 871 | GGGGCGAUGCUGGGGUCCUtt |
| SEQ ID NO: 872 | GACUGCCAGACAUUGACCAtt |
| SEQ ID NO: 873 | GACCAUCUGUGCUCCUCAGtt |
| SEQ ID NO: 874 | UGGUCACUGCUUUGGGCCCtt |
| SEQ ID NO: 875 | CCCCAACCAGUGCUGCCAUtt |
| SEQ ID NO: 876 | CCAGUGCUGCCAUGAUGAGtt |
| SEQ ID NO: 877 | UGACAGUGGAGCCUGUGUAtt |
| SEQ ID NO: 878 | CAAGCUAACUUUCCAGCUGtt |
| SEQ ID NO: 879 | GCUAACUUUCCAGCUGGAAtt |
| SEQ ID NO: 880 | CUUUCCAGCUGGAACCCAAtt |
| SEQ ID NO: 881 | CCCAAUCCCCACACCAAGUtt |
| SEQ ID NO: 882 | UCCCCACACCAAGUAUCAGtt |
| SEQ ID NO: 883 | GUAUCAGUAUGGAGGAGUUtt |
| SEQ ID NO: 884 | CUUUGUGGUGGAUCAAACAtt |
| SEQ ID NO: 885 | ACAUCCUGUGUCAGGGCCUtt |
| SEQ ID NO: 886 | GAUGGAAGUAGAUAAAAAUtt |
| SEQ ID NO: 887 | GUAGAUAAAAAUGGGCUCAtt |
| SEQ ID NO: 888 | AAAUGGGCUCAAGAUGUGUtt |
| SEQ ID NO: 889 | AUGGGCUCAAGAUGUGUGAtt |
| SEQ ID NO: 890 | GAUGUGUGAGCCUUGUGGGtt |
| SEQ ID NO: 891 | AGCCUGUGAGGGAACAGGCtt |
| SEQ ID NO: 892 | CAGGCUCUGGGAGCCGCUUtt |
| SEQ ID NO: 893 | CAUUGAUGGAUUUGUGAACtt |
| SEQ ID NO: 894 | CUGCACCAAGAUCCUGGGCtt |
| SEQ ID NO: 895 | GAUCCUGGGCAACCUGGACtt |
| SEQ ID NO: 896 | CCUGGACUUUCUGAUCACCtt |
| SEQ ID NO: 897 | UGGAGACCCCUGGCACAAGtt |
| SEQ ID NO: 898 | GAUCCCUGCCCUGGACCCAtt |
| SEQ ID NO: 899 | GCUCAAUGUCUUCCGGACAtt |
| SEQ ID NO: 900 | UGUCUUCCGGACAGUACGGtt |
| SEQ ID NO: 901 | CAUCCAGUCCUGGCCGCCCtt |
| SEQ ID NO: 902 | CUUCAGUGUUUUUCCAAUtt |
| SEQ ID NO: 903 | UUUGACAACCAUUGGAGGCtt |
| SEQ ID NO: 904 | CCAUUGGAGGCAGAAGCCUtt |
| SEQ ID NO: 905 | GCCUCUACAACCGGGGCUUtt |
| SEQ ID NO: 906 | CCGGGGCUUCUCAUUGUUGtt |
| SEQ ID NO: 907 | GAACUUGAAUGUCACAUCUtt |
| SEQ ID NO: 908 | CUUGAAUGUCACAUCUCUGtt |
| SEQ ID NO: 909 | UGUCACAUCUCUGGGCUUCtt |
| SEQ ID NO: 910 | GGAAAUUAGUGCUGGGCGUtt |
| SEQ ID NO: 911 | AUUAGUGCUGGGCGUAUCUtt |
| SEQ ID NO: 912 | GUGCCAAUAGGCAGCUCUGtt |
| SEQ ID NO: 913 | UAGGCAGCUCUGCUACCACtt |
| SEQ ID NO: 914 | CUGGACCAAGGUGCUUCGGtt |
| SEQ ID NO: 915 | GGUGCUUCGGGGGCCUACGtt |
| SEQ ID NO: 916 | GAGCGACUAGACAUCAAGCtt |
| SEQ ID NO: 917 | GCAUAAUCGGCCGCGCAGAtt |
| SEQ ID NO: 918 | UCGGCCGCGCAGAGACUGCtt |
| SEQ ID NO: 919 | AGUGUGUGACCCACUGUGCtt |
| SEQ ID NO: 920 | AUUAUAGCCGAGGAGGUGUtt |
| SEQ ID NO: 921 | CUUUCUGAAUGGGGAGCCUtt |
| SEQ ID NO: 922 | UGGGGAGCCUCGAGAAUUUtt |
| SEQ ID NO: 923 | UUUGCCCAUGAGGCCGAAUtt |
| SEQ ID NO: 924 | UGCUUCUCCUGCCACCCGGtt |
| SEQ ID NO: 925 | UGCCAACCCAUGGAGGGCAtt |
| SEQ ID NO: 926 | CCCAUGGAGGGCACUGCCAtt |
| SEQ ID NO: 927 | UGGCUCGGGCUCUGAUACUtt |
| SEQ ID NO: 928 | UGUGCCCAUUUCGAGAUGUtt |
| SEQ ID NO: 929 | GGGCCCAAUCUACAAGUACtt |
| SEQ ID NO: 930 | UCUACAAGUACCCAGAUGUtt |
| SEQ ID NO: 931 | GUACCCAGAUGUUCAGAAUtt |
| SEQ ID NO: 932 | UGAAUGUCGGCCCUGCCAUtt |
| SEQ ID NO: 933 | UGUCGGCCCUGCCAUGAGAtt |
| SEQ ID NO: 934 | CUGCACCCAGGGGUGUAAAtt |
| SEQ ID NO: 935 | AGGACCAGAGCUUCAAGACtt |
| SEQ ID NO: 936 | GACUGUUUAGGACAAACACtt |
| SEQ ID NO: 937 | ACACUGGUGCUGAUCGGCAtt |
| SEQ ID NO: 938 | AACCCAUCUGACAAUGGCUtt |
| SEQ ID NO: 939 | CCCAUCUGACAAUGGCUUUtt |
| SEQ ID NO: 940 | UGGCUUUGACAGUGAUAGCtt |
| SEQ ID NO: 941 | UAAAAGGGCUAUGAGGCGAtt |
| SEQ ID NO: 942 | AAGGGCUAUGAGGCGAUACtt |
| SEQ ID NO: 943 | GGGCUAUGAGGCGAUACUUtt |
| SEQ ID NO: 944 | CGGGGUGAGAGCAUAGAGCtt |

TABLE 6-continued

Candidate siRNAs for ERBB3, SEQ ID NOs: 489-568 are based on NM_001005915 and SEQ ID NOs: 569-1120 are based on NM_001982.

| SEQ ID NO | Sequence |
|---|---|
| SEQ ID NO: 945 | GGCUAACAAAGUCUUGGCCtt |
| SEQ ID NO: 946 | CAAAGUCUUGGCCAGAAUCtt |
| SEQ ID NO: 947 | AGUCUUGGCCAGAAUCUUCtt |
| SEQ ID NO: 948 | UCUUCAAAGAGACAGAGCUtt |
| SEQ ID NO: 949 | AGAGACAGAGCUAAGGAAGtt |
| SEQ ID NO: 950 | GGAAGCUUAAAGUGCUUGGtt |
| SEQ ID NO: 951 | GCUUAAAGUGCUUGGCUCGtt |
| SEQ ID NO: 952 | AGUGCUUGGCUCGGUGUCtt |
| SEQ ID NO: 953 | CUGUGCACAAAGGAGUGUGtt |
| SEQ ID NO: 954 | AGGAGUGUGGAUCCCUGAGtt |
| SEQ ID NO: 955 | UCAAUCAAGAUUCCAGUCUtt |
| SEQ ID NO: 956 | UCAAGAUUCCAGUCUGCAUtt |
| SEQ ID NO: 957 | GAUUCCAGUCUGCAUUAAAtt |
| SEQ ID NO: 958 | AGUCAUUGAGGACAAGAGUtt |
| SEQ ID NO: 959 | GAGUGGACGGCAGAGUUUUtt |
| SEQ ID NO: 960 | GCUGUGACAGAUCAUAUGCtt |
| SEQ ID NO: 961 | GGCUGCUGGGACUAUGCCCtt |
| SEQ ID NO: 962 | UAUUUGCCUCUGGGUUUCUCtt |
| SEQ ID NO: 963 | CACCGGGGGGCACUGGGGCtt |
| SEQ ID NO: 964 | CUGGGGAGUACAAAUUGCCtt |
| SEQ ID NO: 965 | AUUGCCAAGGGAAUGUACUtt |
| SEQ ID NO: 966 | GGGAAUGUACUACCUUGAGtt |
| SEQ ID NO: 967 | UGUACUACCUUGAGGAACAtt |
| SEQ ID NO: 968 | CAUGGUAUGGUGCAUAGAAtt |
| SEQ ID NO: 969 | ACCUGGCUGCCCGAAACGUtt |
| SEQ ID NO: 970 | ACGUGCUACUCAAGUCACCtt |
| SEQ ID NO: 971 | GUCACCCAGUCAGGUUCAGtt |
| SEQ ID NO: 972 | GCAGCUGCUAUACAGUGAGtt |
| SEQ ID NO: 973 | GACUCCAAUUAAGUGGAUGtt |
| SEQ ID NO: 974 | UUAAGUGGAUGGCCCUUGAtt |
| SEQ ID NO: 975 | GUGGAUGGCCCUUGAGAGUtt |
| SEQ ID NO: 976 | AUACACACACCAGAGUGAUtt |
| SEQ ID NO: 977 | GUACCAGACCUGCUAGAGAtt |
| SEQ ID NO: 978 | GGGGGAGCGGUUGGCACAGtt |
| SEQ ID NO: 979 | UUGAUGUCUACAUGGUGAUtt |
| SEQ ID NO: 980 | GUGUUGGAUGAUUGAUGAGtt |
| SEQ ID NO: 981 | CAUUCGCCCAACCUUUAAAtt |
| SEQ ID NO: 982 | CCUUUAAAGAACUAGCCAAtt |
| SEQ ID NO: 983 | AGAACUAGCCAAUGAGUUCtt |
| SEQ ID NO: 984 | CUAGCCAAUGAGUUCACCAtt |
| SEQ ID NO: 985 | UGAGUUCACCAGGAUGGCCtt |
| SEQ ID NO: 986 | AGAGAGAGAGUGGGCCUGGtt |
| SEQ ID NO: 987 | UAGCCCUGGGCCAGAGCCtt |
| SEQ ID NO: 988 | ACAAGAAGCUAGAGGAAGUtt |
| SEQ ID NO: 989 | GAAGCUAGAGGAAGUAGAGtt |
| SEQ ID NO: 990 | GCUAGAGGAAGUAGAGCUGtt |
| SEQ ID NO: 991 | GUAGAGCUGGAGCCAGAACtt |
| SEQ ID NO: 992 | CUAGACCUAGACCUAGACUtt |
| SEQ ID NO: 993 | GCAGAGGAGGACAACCUGGtt |
| SEQ ID NO: 994 | CCUGGCAACCACCACACUGtt |
| SEQ ID NO: 995 | CCACCACACUGGGCUCCGCtt |
| SEQ ID NO: 996 | CACUUAAUCGCCACGUGGtt |
| SEQ ID NO: 997 | UCGGCCACGUGGGAGCCAGtt |
| SEQ ID NO: 998 | GUCCAUCAUCUGGAUACAUtt |
| SEQ ID NO: 999 | CCAGGGUAAUCUUGGGGAGtt |
| SEQ ID NO: 1000 | UCUUGGGGAGUCUUGCCAGtt |
| SEQ ID NO: 1001 | CGGUGCCCCCGUCCAGUCUtt |
| SEQ ID NO: 1002 | UGCCACGGGGAUGCCUGGCtt |
| SEQ ID NO: 1003 | CAGGCUCUGAGGCUGAGCUtt |
| SEQ ID NO: 1004 | AGUGUCAAUGUGUAGGAGCtt |
| SEQ ID NO: 1005 | UGUGUAGGAGCCGGAGCAGtt |
| SEQ ID NO: 1006 | GAGGAUGUCAACGGUUAUGtt |
| SEQ ID NO: 1007 | CGGUUAUGUCAUGCCAGAUtt |
| SEQ ID NO: 1008 | AGGUACUCCCUCCUCCCGGtt |
| SEQ ID NO: 1009 | GGCACCCUUUCUUCAGUGGtt |
| SEQ ID NO: 1010 | GAAGAAGAUGAAGAUGAGGtt |
| SEQ ID NO: 1011 | GAAGAUGAAGAUGAGGAGUtt |
| SEQ ID NO: 1012 | GAUGAAGAUGAGGAGUAUGtt |
| SEQ ID NO: 1013 | GAUGAGGAGUAUGAAUACAtt |
| SEQ ID NO: 1014 | UACAUGAACCGGAGGAGAAtt |
| SEQ ID NO: 1015 | CCGGAGGAGAAGGCACAGUtt |
| SEQ ID NO: 1016 | GGCACAGUCCACCUCAUCCtt |
| SEQ ID NO: 1017 | GUUCCCUUGAGGAGCUGGGtt |
| SEQ ID NO: 1018 | CUCCAGAUGAAGACUAUGAtt |
| SEQ ID NO: 1019 | GACUAUGAAUAUAUGAAUCtt |
| SEQ ID NO: 1020 | UAUAUGAAUCGGCAACGAGtt |

TABLE 6-continued

Candidate siRNAs for ERBB3, SEQ ID NOs: 489-568 are based on NM_001005915 and SEQ ID NOs: 569-1120 are based on NM_001982.

| SEQ ID NO: 1021 | UCGGCAACGAGAUGGAGGUtt |
| SEQ ID NO: 1022 | CGAGAUGGAGGUGGUCCUGtt |
| SEQ ID NO: 1023 | GGGUAUGAAGAGAUGAGAGtt |
| SEQ ID NO: 1024 | GAGAUGAGAGCUUUUCAGGtt |
| SEQ ID NO: 1025 | AAACUCUACGUAGCUUAGAtt |
| SEQ ID NO: 1026 | ACUCUACGUAGCUUAGAGGtt |
| SEQ ID NO: 1027 | CCCUGAUUACUGGCAUAGCtt |
| SEQ ID NO: 1028 | GGCUAAUGCCCAGAGAACGtt |
| SEQ ID NO: 1029 | UGCCCAGAGAACGUAACUCtt |
| SEQ ID NO: 1030 | CGUAACUCCUGCUCCCUGUtt |
| SEQ ID NO: 1031 | CUCCUGCUCCCUGUGGCACtt |
| SEQ ID NO: 1032 | UGGCAGCUAGUGCCUUUAGtt |
| SEQ ID NO: 1033 | UUCCAUUCAAUCUUUGGAGtt |
| SEQ ID NO: 1034 | UCUUUGGAGGCUUUUAAACtt |
| SEQ ID NO: 1035 | ACAUUUGACACAAAAUUCtt |
| SEQ ID NO: 1036 | AAUUCUUAUGGUAUGUAGCtt |
| SEQ ID NO: 1037 | UUCUUAUGGUAUGUAGCCAtt |
| SEQ ID NO: 1038 | CCCCAGGAAAGGUUUUCCUtt |
| SEQ ID NO: 1039 | AGGUUUUCCUUAUUUUGUGtt |
| SEQ ID NO: 1040 | GGAUUACUCUCCAUAUCCCtt |
| SEQ ID NO: 1041 | CUAGGCUCUUAUGUGUGCCtt |
| SEQ ID NO: 1042 | GAAGAGGAAAGGGAGGAAAtt |
| SEQ ID NO: 1043 | GAGGAAAGGGAGGAAACCUtt |
| SEQ ID NO: 1044 | AGGGAGGAAACCUAGCAGAtt |
| SEQ ID NO: 1045 | ACCUAGCAGAGGAAAGUGUtt |
| SEQ ID NO: 1046 | AGUGUAAUUUUGGUUUAUGtt |
| SEQ ID NO: 1047 | UUUUGGUUUAUGACUCUUAtt |
| SEQ ID NO: 1048 | CCCCUAGAAAGACAGAAGtt |
| SEQ ID NO: 1049 | AGACAGAAGCUUAAAAUCUtt |
| SEQ ID NO: 1050 | GCUUAAAAUCUGUGAAGAAtt |
| SEQ ID NO: 1051 | AAUCUGUGAAGAAAGAGGUtt |
| SEQ ID NO: 1052 | UCUGUGAAGAAAGAGGUUAtt |
| SEQ ID NO: 1053 | GAAAGAGGUUAGGAGUAGAtt |
| SEQ ID NO: 1054 | AGAGGUUAGGAGUAGAUAUtt |
| SEQ ID NO: 1055 | UUCAGCACUUAACUAUAGAtt |
| SEQ ID NO: 1056 | CUAUGAGCCAGGCAUCAUAtt |
| SEQ ID NO: 1057 | ACUUCACCUACAUUAUCUCtt |
| SEQ ID NO: 1058 | AACAAUUCUGUGACAUACAtt |
| SEQ ID NO: 1059 | CAAUUCUGUGACAUACAUAtt |
| SEQ ID NO: 1060 | UUCUGUGACAUACAUAUUAtt |
| SEQ ID NO: 1061 | AGGGAAGUCGGGCAUGGUGtt |
| SEQ ID NO: 1062 | GUCGGGCAUGGUGGCUCAUtt |
| SEQ ID NO: 1063 | UCUCAGCACUUUGGGAGGCtt |
| SEQ ID NO: 1064 | GGAUUACCUGAGGCAAGGAtt |
| SEQ ID NO: 1065 | GGAGUUUGAGACCAGCUUAtt |
| SEQ ID NO: 1066 | CAUAGUAAGACCCCCAUCUtt |
| SEQ ID NO: 1067 | GACCCCCAUCUCUUUAAAAtt |
| SEQ ID NO: 1068 | AAAAAAAAAAAAAAAAAAtt |
| SEQ ID NO: 1069 | AAAAAAAAAAAAAAAAACtt |
| SEQ ID NO: 1070 | AAAAAAAAAAAAAAACUtt |
| SEQ ID NO: 1071 | AAAAAAAAAAAAACUUUAtt |
| SEQ ID NO: 1072 | AAAAAAAAAAACUUUAGAtt |
| SEQ ID NO: 1073 | AAAAAAAAACUUUAGAACtt |
| SEQ ID NO: 1074 | AAAAAAACUUUAGAACUGtt |
| SEQ ID NO: 1075 | AAAAAACUUUAGAACUGGGtt |
| SEQ ID NO: 1076 | AAAACUUUAGAACUGGGUGtt |
| SEQ ID NO: 1077 | AACUUUAGAACUGGGUGCAtt |
| SEQ ID NO: 1078 | CUUUAGAACUGGGUGCAGUtt |
| SEQ ID NO: 1079 | CUGGGUGCAGUGGCUCAUGtt |
| SEQ ID NO: 1080 | UCCCAGCCAGCACUUUGGGtt |
| SEQ ID NO: 1081 | GAUCACUUGAGCCCAGAAUtt |
| SEQ ID NO: 1082 | UUAGAGAUAAGCCUAUGGAtt |
| SEQ ID NO: 1083 | GCCUAUGGAAACAUAGCAAtt |
| SEQ ID NO: 1084 | ACAUAGCAAGACACUGUCUtt |
| SEQ ID NO: 1085 | GACACUGUCUCUACAGGGGtt |
| SEQ ID NO: 1086 | AAAAAAAAAGAAACUGAGtt |
| SEQ ID NO: 1087 | AAAAAAAAGAAACUGAGCCtt |
| SEQ ID NO: 1088 | AAAAAGAAACUGAGCCUUtt |
| SEQ ID NO: 1089 | AAAAGAAACUGAGCCUUAAtt |
| SEQ ID NO: 1090 | AAGAAACUGAGCCUUAAAGtt |
| SEQ ID NO: 1091 | GAAACUGAGCCUUAAAGAGtt |
| SEQ ID NO: 1092 | ACUGAGCCUUAAAGAGAUGtt |
| SEQ ID NO: 1093 | AGAGAUGAAUAAAUUAAGtt |
| SEQ ID NO: 1094 | AUAAAUUAAGCAGUAGAUCtt |
| SEQ ID NO: 1095 | AUUAAGCAGUAGAUCCAGGtt |
| SEQ ID NO: 1096 | GCAGUAGAUCCAGGAUGCAtt |

TABLE 6-continued

Candidate siRNAs for ERBB3, SEQ ID NOs: 489-568 are based on NM_001005915 and SEQ ID NOs: 569-1120 are based on NM_001982.

| | |
|---|---|
| SEQ ID NO: 1097 | AAUCCUCCCAAUUCCUGUGtt |
| SEQ ID NO: 1098 | UCCUCCCAAUUCCUGUGCAtt |
| SEQ ID NO: 1099 | UUCCUGUGCAUGUGCUCUUtt |
| SEQ ID NO: 1100 | GGUGCCAAGAAAAACUGAUtt |
| SEQ ID NO: 1101 | GAAAAACUGAUUUAAGUUAtt |
| SEQ ID NO: 1102 | AAACUGAUUUAAGUUACAGtt |
| SEQ ID NO: 1103 | ACUGAUUUAAGUUACAGCCtt |
| SEQ ID NO: 1104 | GUUACAGCCCUUGUUUAAGtt |
| SEQ ID NO: 1105 | GGGGCACUGUUUCUUGUUUtt |
| SEQ ID NO: 1106 | UCAAGUCUAACCCCAACAGtt |
| SEQ ID NO: 1107 | GUCUAACCCCAACAGCCACtt |
| SEQ ID NO: 1108 | CCCCAACAGCCACAUCCUCtt |
| SEQ ID NO: 1109 | CAGCCACAUCCUCCUAUACtt |
| SEQ ID NO: 1110 | GUGGUGGUGGGGUAGUCAtt |
| SEQ ID NO: 1111 | GGAAAAAUAACUGGACAUCtt |
| SEQ ID NO: 1112 | AAAUAACUGGACAUCUUUGtt |
| SEQ ID NO: 1113 | AUAACUGGACAUCUUUGUGtt |
| SEQ ID NO: 1114 | CUGGACAUCUUUGUGUAAAtt |
| SEQ ID NO: 1115 | ACCAUAAUCCACAUGUGCCtt |
| SEQ ID NO: 1116 | UCCACAUGUGCCGUAAAUGtt |
| SEQ ID NO: 1117 | AUGAUCUUCACUCCUUAUCtt |
| SEQ ID NO: 1118 | AUUCACAAGGAUCCCCAAGtt |
| SEQ ID NO: 1119 | GGAUCCCCAAGAUCCACUUtt |
| SEQ ID NO: 1120 | GAUCCACUUUUAGAAGCCAtt |

TABLE 7

Candidate siRNAs for IKZF4, SEQ ID NOs: 1121-1592 are based on NM_022465.

| | |
|---|---|
| SEQ ID NO: 1121 | GGCCCAGGACACGGACAGCtt |
| SEQ ID NO: 1122 | GAGGGAAAGGCAGAUGCUGtt |
| SEQ ID NO: 1123 | CUAGGCUACAGCAUCCCUtt |
| SEQ ID NO: 1124 | UGCUAGGCUACAGCAUCCCtt |
| SEQ ID NO: 1125 | AGAGCACGCUUGGAUGUGCtt |
| SEQ ID NO: 1126 | AGGAGAGGGGAGAGCACGCtt |
| SEQ ID NO: 1127 | AGCCCAGGGUGUAUGUGUGtt |
| SEQ ID NO: 1128 | UGAGGGGAACCGCCGUCAUtt |
| SEQ ID NO: 1129 | ACCUUCCAGGAAGCGUGGAtt |
| SEQ ID NO: 1130 | GUGAGCCCAGCCACUCACCtt |
| SEQ ID NO: 1131 | UGCGAACGCGGCCGCCGCCtt |
| SEQ ID NO: 1132 | UCUCCAGAUUAUCCUUCCCtt |
| SEQ ID NO: 1133 | AUCCCUCUCCAGAUUAUCCtt |
| SEQ ID NO: 1134 | UGAGGGAUCCCUCUCCAGAtt |
| SEQ ID NO: 1135 | UUAUAAAUGGUUGGAGUCtt |
| SEQ ID NO: 1136 | AGAUUCCAUUAUAAAUGGtt |
| SEQ ID NO: 1137 | UCACAAAAUAAAGAUUCCAtt |
| SEQ ID NO: 1138 | UACUUUCACAAAAUAAAGAtt |
| SEQ ID NO: 1139 | GAGAUGAGUCCCCGCUACUtt |
| SEQ ID NO: 1140 | UGGGGCCCGAGGAACUCCtt |
| SEQ ID NO: 1141 | AGGAGAAGAGUGCUGGCUGtt |
| SEQ ID NO: 1142 | CAUCUCCACCUUGAUGGAGtt |
| SEQ ID NO: 1143 | AUCGCUGUACAUCUCCACCtt |
| SEQ ID NO: 1144 | UCUGGCCCAGCAGUCUGCtt |
| SEQ ID NO: 1145 | CAAUCACGCUGUCGUCCUUtt |
| SEQ ID NO: 1146 | CACAAUCACGCUGUCGUCCtt |
| SEQ ID NO: 1147 | GGGGCUCAGACAAUGAAUCtt |
| SEQ ID NO: 1148 | GUCACACUUGAGCUUGCCAtt |
| SEQ ID NO: 1149 | GCAGACGUCACACUUGAGCtt |
| SEQ ID NO: 1150 | CAUGCCGCAGACGUCACACtt |
| SEQ ID NO: 1151 | CUUGUGCACCAUGAGCACGtt |
| SEQ ID NO: 1152 | UUCACCAGUGUGACUGCGCtt |
| SEQ ID NO: 1153 | GGUUGCAAUGGAAGGGCCUtt |
| SEQ ID NO: 1154 | GAAGGAGGCACCACACUGGtt |
| SEQ ID NO: 1155 | GUGGCGCAGCAGGUUCCCtt |
| SEQ ID NO: 1156 | CUUGAUGUGGCGCAGCAGGtt |
| SEQ ID NO: 1157 | CUUCUCCCCAGAGUGCAGCtt |
| SEQ ID NO: 1158 | GAAGGGACAUUUAAAGGGCtt |
| SEQ ID NO: 1159 | AUAGUUGCAGAAGGGACAUtt |
| SEQ ID NO: 1160 | ACGCCGGCGGCAGGCAUAGtt |
| SEQ ID NO: 1161 | GUAGUUACACUUGUAGGGCtt |
| SEQ ID NO: 1162 | CCGGCCACAGUAGUUACACtt |
| SEQ ID NO: 1163 | GUAGCUCCGGCCACAGUAGtt |
| SEQ ID NO: 1164 | CUCCAGGGUACUCUGCUGUtt |
| SEQ ID NO: 1165 | GUAGUUAUGGCACCGCUCCtt |
| SEQ ID NO: 1166 | GCUGAGACUCUGUAGGUAGtt |
| SEQ ID NO: 1167 | GGCCAGCCAAAGCUUGGGCtt |
| SEQ ID NO: 1168 | CUGGUUGGCCAGCCAAAGCtt |
| SEQ ID NO: 1169 | CACGUAUUUCGUCACCUGGtt |

TABLE 7-continued

Candidate siRNAs for IKZF4, SEQ ID NOs: 1121-1592 are based on NM_022465.

| SEQ ID NO: | Sequence |
|---|---|
| SEQ ID NO: 1170 | CCAUCUCCAGGUCACGUAUtt |
| SEQ ID NO: 1171 | GCCAGACGAUCGAUGAAAGtt |
| SEQ ID NO: 1172 | CUUGCGUUUGGUGAGGCUAtt |
| SEQ ID NO: 1173 | GGGUGUGGAACGCUUGCGUtt |
| SEQ ID NO: 1174 | CUUCUGGGGUGUGGAACGCtt |
| SEQ ID NO: 1175 | CUGCUUUUCGCCUACAAACtt |
| SEQ ID NO: 1176 | GGCUGAAGCGCAUCUGCUUtt |
| SEQ ID NO: 1177 | GAGGCUGAAGCGCAUCUGCtt |
| SEQ ID NO: 1178 | CUUUUCAUAGCCACCCGAGtt |
| SEQ ID NO: 1179 | CCACCAACUCCACAUCCUUtt |
| SEQ ID NO: 1180 | UGCCACCAACUCCACAUCCtt |
| SEQ ID NO: 1181 | CCCACAAAGGCCAGGGAACtt |
| SEQ ID NO: 1182 | CGUGAGUUCUGAGAUGCAAtt |
| SEQ ID NO: 1183 | AGCUGAUGACAGGCGUGAGtt |
| SEQ ID NO: 1184 | CCUCAGGUCCCUCACCUGCtt |
| SEQ ID NO: 1185 | UGUGGAGUCCUGGCAGCCAtt |
| SEQ ID NO: 1186 | CCCGAUCUUCGUGGUUGCUtt |
| SEQ ID NO: 1187 | CGCAACCCGAUCUUCGUGGtt |
| SEQ ID NO: 1188 | CCACCCCGCAACCCGAUCtt |
| SEQ ID NO: 1189 | CUGUGGCUUGGGGUCCUCUtt |
| SEQ ID NO: 1190 | CAAUAACCCCUCCUGUGGCtt |
| SEQ ID NO: 1191 | CACCACCCGAAGCACUUCCtt |
| SEQ ID NO: 1192 | CGCCCACCACCCGAAGCACtt |
| SEQ ID NO: 1193 | GUGCUCACACUUGAAGGCCtt |
| SEQ ID NO: 1194 | GAUACGGCAGUGCUCACACtt |
| SEQ ID NO: 1195 | GCUGUGAUAACCACAGAUGtt |
| SEQ ID NO: 1196 | GGACAAUGUGGGAAGAGAAtt |
| SEQ ID NO: 1197 | GAGAGGUUGCUAGCCCACCtt |
| SEQ ID NO: 1198 | CUGAGGAGAGGGAGAGGtt |
| SEQ ID NO: 1199 | GGCUACAAAGCAAAACUCCtt |
| SEQ ID NO: 1200 | AUCUGUUUCAUCACAAUGCtt |
| SEQ ID NO: 1201 | ACAUAAGCAAAAGAUCUGUtt |
| SEQ ID NO: 1202 | GCAAAAUAAAUCAACUAAtt |
| SEQ ID NO: 1203 | GACUGAUAUAAGUUAAAAUtt |
| SEQ ID NO: 1204 | GGCAAGUGACUGAUAUAAGtt |
| SEQ ID NO: 1205 | GGCCUAAAGUGGAAAGGAGtt |
| SEQ ID NO: 1206 | AAGAUCUAGAGAGAAAAAtt |
| SEQ ID NO: 1207 | UCUUAGUACUAAGAGGAGCtt |
| SEQ ID NO: 1208 | GCAAGAAGCUUGAAGUCUCtt |
| SEQ ID NO: 1209 | AGGACUUAAAGCAAGAAGCtt |
| SEQ ID NO: 1210 | UAAUGUAAAGGGUGAGGACtt |
| SEQ ID NO: 1211 | CAGCAUCAAAACUGAAGAAtt |
| SEQ ID NO: 1212 | AGAGGUAUGGAGUACCAGGtt |
| SEQ ID NO: 1213 | GGAAAUAAUUCUUCAUUCAtt |
| SEQ ID NO: 1214 | AUGAGGAAAUAAUUCUUCAtt |
| SEQ ID NO: 1215 | CCAAAUGAGGAAAUAAUUCtt |
| SEQ ID NO: 1216 | CUUCCAAAUGAGGAAAUAAtt |
| SEQ ID NO: 1217 | UUUCUUCAGUCCCUCCUACtt |
| SEQ ID NO: 1218 | AGUGCCUGGGGAGAAUUUCtt |
| SEQ ID NO: 1219 | CACAGUGCCUGGGGAGAAUtt |
| SEQ ID NO: 1220 | ACUAGGGGAAUAUGACCUAtt |
| SEQ ID NO: 1221 | UAGGCUUUGAGAACUCAUAtt |
| SEQ ID NO: 1222 | GAGAUCCUGAAUGUAGGCUtt |
| SEQ ID NO: 1223 | AGAGCGUGUGGAGGGGUAGtt |
| SEQ ID NO: 1224 | CACUUAAUAGACCGGUAGGtt |
| SEQ ID NO: 1225 | AGGAGAGAAAAGCCACCACtt |
| SEQ ID NO: 1226 | GGCCCCUGAGAAUAUAAAAtt |
| SEQ ID NO: 1227 | GAGGGUUGCAGACCUAGCCtt |
| SEQ ID NO: 1228 | AUCUGUCAGAGACAGAGGtt |
| SEQ ID NO: 1229 | CCCAUGCCCUGGUUCCCAAtt |
| SEQ ID NO: 1230 | CUCCUUUCCCAUGCCCUGGtt |
| SEQ ID NO: 1231 | AGAAUUUUGACCCACUCCUtt |
| SEQ ID NO: 1232 | GAGGAGAAAGAGAAGAAUUtt |
| SEQ ID NO: 1233 | UGGAGGAGAAAGAGAAGAAtt |
| SEQ ID NO: 1234 | GUCACUAUAGUGAAGAAGUtt |
| SEQ ID NO: 1235 | CAGGCAGCAACCCACUAGUtt |
| SEQ ID NO: 1236 | GAGGGGCUGAAACAACCCtt |
| SEQ ID NO: 1237 | AGAGAAAAGAGAUACCCGUtt |
| SEQ ID NO: 1238 | UUUUUGGUUAUACUGAAAAtt |
| SEQ ID NO: 1239 | AUGCUGGGAUAAUUUUGGtt |
| SEQ ID NO: 1240 | GCUCAUGCUGGGAUAAUUUtt |
| SEQ ID NO: 1241 | GUGCUCAUGCUGGGAUAAUtt |
| SEQ ID NO: 1242 | AGUUGUACCCAUCCCAGUCtt |
| SEQ ID NO: 1243 | AAGGAAGACCCCAGUUCAGtt |
| SEQ ID NO: 1244 | UAGUAAAGGAAGACCCCAGtt |
| SEQ ID NO: 1245 | CCUUCUCACUAAUCCUAGGtt |
| SEQ ID NO: 1246 | UUGUAUCUCCUUCUGCCCCtt |

TABLE 7-continued

Candidate siRNAs for IKZF4, SEQ ID NOs: 1121-1592 are based on NM_022465.

| SEQ ID NO: 1247 | GCAGUGGAGUUGUAUCUCCtt |
|---|---|
| SEQ ID NO: 1248 | ACCUCCACUUGCAGUGGAGtt |
| SEQ ID NO: 1249 | UGUAGAAAGAAACCUCCACtt |
| SEQ ID NO: 1250 | GGCCUUGGGCAGAAAACUCtt |
| SEQ ID NO: 1251 | GAGUGGGAUGGCUGUGGCCtt |
| SEQ ID NO: 1252 | UAGAAAACAGCCUUUGGUtt |
| SEQ ID NO: 1253 | AAACAUAGAAAACAGCCUtt |
| SEQ ID NO: 1254 | UUUUUACUUUUUUUUUCUtt |
| SEQ ID NO: 1255 | UUGGUUUUUACUUUUUUUtt |
| SEQ ID NO: 1256 | GUUUGGUUUUACUUUUUUtt |
| SEQ ID NO: 1257 | GUGUUUGGUUUUUACUUUUtt |
| SEQ ID NO: 1258 | UUGUGUUUGGUUUUUACUUtt |
| SEQ ID NO: 1259 | UGUUGUGUUUGGUUUUUACtt |
| SEQ ID NO: 1260 | GAGGUGUUUGUGUUUGGUUUtt |
| SEQ ID NO: 1261 | GUGAGGUGUUUGUGUUUGGUtt |
| SEQ ID NO: 1262 | AACUUGUGAGGUGUUUGUGtt |
| SEQ ID NO: 1263 | AGUUACAACUUGUGAGGUGtt |
| SEQ ID NO: 1264 | AAGGACCAAGAGUUACAACtt |
| SEQ ID NO: 1265 | GAGAGAGAAGGACCAAGAGtt |
| SEQ ID NO: 1266 | CUGUUCCUUAGCCCACCCUtt |
| SEQ ID NO: 1267 | UAAUCCCAGGGUCUGUUCCtt |
| SEQ ID NO: 1268 | GCCCUAAUCCCAGGGUCUGtt |
| SEQ ID NO: 1269 | UAGACUCCUCUCAGAGCCCtt |
| SEQ ID NO: 1270 | AAGUUUUUAGGGUCUCCCtt |
| SEQ ID NO: 1271 | ACAAAGAGGAGAAAGUUUUtt |
| SEQ ID NO: 1272 | GGACAAAGAGGAGAAAGUUtt |
| SEQ ID NO: 1273 | GAGGACAAAGAGGAGAAAGtt |
| SEQ ID NO: 1274 | CCCUGCCAAUCUGGUUCUCtt |
| SEQ ID NO: 1275 | CUUCUCCCUGCCAAUCUGGtt |
| SEQ ID NO: 1276 | AACAAUUGCCCCACAAUGCtt |
| SEQ ID NO: 1277 | CAUUGUCAAGGAGGAACAAtt |
| SEQ ID NO: 1278 | GCAUCUAUUUAUUGCUACAtt |
| SEQ ID NO: 1279 | CCUUGGCAGCAUCUAUUUAtt |
| SEQ ID NO: 1280 | UGCCCUUGGCAGCAUCUAUtt |
| SEQ ID NO: 1281 | ACCUCCCAUUUCUGCCCtt |
| SEQ ID NO: 1282 | CUGAGCUAACCUCCCCAUUtt |
| SEQ ID NO: 1283 | CUCUGAGCUAACCUCCCCAtt |
| SEQ ID NO: 1284 | GCCGUUGAGGAUUCUUCCUtt |
| SEQ ID NO: 1285 | AGGGUGCCGUUGAGGAUUCtt |
| SEQ ID NO: 1286 | CCCAGGGUGCCGUUGAGGAtt |
| SEQ ID NO: 1287 | CUAGCACCCCAGGGUGCCGtt |
| SEQ ID NO: 1288 | AAUCUCAGCUCUGCUGACAtt |
| SEQ ID NO: 1289 | UUCAGGAAAAGCCCAGAUAtt |
| SEQ ID NO: 1290 | GGCUCAAUAACCAGAAUAGtt |
| SEQ ID NO: 1291 | CCCCAGAAGGGACUAGUCCtt |
| SEQ ID NO: 1292 | GAGGUUACAGGUGCCACAGtt |
| SEQ ID NO: 1293 | UCCUUCAUGUUCCGGGAGGtt |
| SEQ ID NO: 1294 | CAGAGCAUAGUCCUUCAUGtt |
| SEQ ID NO: 1295 | UAGCCUCAGAGCAUAGUCCtt |
| SEQ ID NO: 1296 | UUAGCACCUGGUCUUGCCCtt |
| SEQ ID NO: 1297 | CCCUCCUUAGCACCUGGUCtt |
| SEQ ID NO: 1298 | GAUGCCCCUCUCCCCUCCtt |
| SEQ ID NO: 1299 | UUUGUACCUAAGACCCUGGtt |
| SEQ ID NO: 1300 | GGCUCUGAAAAGUAGGAUUtt |
| SEQ ID NO: 1301 | AAGGCUCUGAAAAGUAGGAtt |
| SEQ ID NO: 1302 | AGCAUGAGGAUGUUUGAGGtt |
| SEQ ID NO: 1303 | GGAGAGAGCAUGAGGAUGUtt |
| SEQ ID NO: 1304 | UUUUUCUUUACUUUUUUUUtt |
| SEQ ID NO: 1305 | UCUUUUUCUUUACUUUUUUtt |
| SEQ ID NO: 1306 | UUUCUUUUUCUUUACUUUUtt |
| SEQ ID NO: 1307 | UUUUUCUUUUUCUUUACUUtt |
| SEQ ID NO: 1308 | UUUUUUUCUUUUUCUUUACtt |
| SEQ ID NO: 1309 | UAUUUUUUUUCUUUUUCUtt |
| SEQ ID NO: 1310 | UGUGUAUUUUUUUUCUUUtt |
| SEQ ID NO: 1311 | UGUGUGUAUUUUUUUUCUtt |
| SEQ ID NO: 1312 | AGUGUGUGUAUUUUUUUUtt |
| SEQ ID NO: 1313 | UCAGUGUGUGUAUUUUUUtt |
| SEQ ID NO: 1314 | UUUCAGUGUGUGUAUUUUtt |
| SEQ ID NO: 1315 | GGUUUCAGUGUGUGUGUAUtt |
| SEQ ID NO: 1316 | CUCUUUUCUCCAUGUGGGUtt |
| SEQ ID NO: 1317 | AUAAAGGAAACACCUCUUtt |
| SEQ ID NO: 1318 | AUAUAAAGGAAACACCUCtt |
| SEQ ID NO: 1319 | UUUGUUGGUGGUAUUGAUUtt |
| SEQ ID NO: 1320 | AUUUUGUUGGUGGUAUUGAtt |
| SEQ ID NO: 1321 | AAAUAUUUUGUUGGUGGUAtt |
| SEQ ID NO: 1322 | UCUACUUGAAAUAUUUUGtt |
| SEQ ID NO: 1323 | GUGUCUACUUGAAAUAUUtt |

TABLE 7-continued

Candidate siRNAs for IKZF4, SEQ ID NOs: 1121-1592 are based on NM_022465.

| SEQ ID NO: 1324 | AAGUGUCUACUUAGAAAUAtt |
| SEQ ID NO: 1325 | GGUCUGGAAAAGUGUCUACtt |
| SEQ ID NO: 1326 | ACAAAAUCCUAUCUGCAGCtt |
| SEQ ID NO: 1327 | AAAGAAGCUGCCAGAAGUAtt |
| SEQ ID NO: 1328 | AUAUAUGUAUAUAUAUAUAtt |
| SEQ ID NO: 1329 | UGUUCUUCAUAACUUCUGAtt |
| SEQ ID NO: 1330 | UCUUUUGUUCUUCAUAACtt |
| SEQ ID NO: 1331 | UUAUUUUUCUUUUUGUUCtt |
| SEQ ID NO: 1332 | UGUUUAUUUUUCUUUUUGtt |
| SEQ ID NO: 1333 | CUGUGUUUAUUUUUUCUUUtt |
| SEQ ID NO: 1334 | UUCUGUGUUUAUUUUUUCUtt |
| SEQ ID NO: 1335 | UUGCUUCUGUGUUUAUUUUtt |
| SEQ ID NO: 1336 | ACUUGCUUCUGUGUUUAUUtt |
| SEQ ID NO: 1337 | GCACUUGCUUCUGUGUUUAtt |
| SEQ ID NO: 1338 | AUUGCACUUGCUUCUGUGUtt |
| SEQ ID NO: 1339 | GAGGUGGUAUUGCACUUGCtt |
| SEQ ID NO: 1340 | AAGAGAGGUGGUAUUGCACtt |
| SEQ ID NO: 1341 | AGGGAGAAGAGAGGUGGUAtt |
| SEQ ID NO: 1342 | GAGAAAGGAGAAAAACUCUtt |
| SEQ ID NO: 1343 | AAAGCUAGUUUAACUCCCCtt |
| SEQ ID NO: 1344 | AUAAGUCUCAAAAGCUAGUtt |
| SEQ ID NO: 1345 | AUUACAUAUACAAAAUGCUtt |
| SEQ ID NO: 1346 | AAUAUUUACUUACAAUAUAtt |
| SEQ ID NO: 1347 | CCGUUACACAAAUAUUUACtt |
| SEQ ID NO: 1348 | AUCUCCGUUACACAAAUAUtt |
| SEQ ID NO: 1349 | UUACAGUAGUAUAUCUCCGtt |
| SEQ ID NO: 1350 | AGCCAGUACAGUACAAAACtt |
| SEQ ID NO: 1351 | UGUUUAUUUAUAACAGACtt |
| SEQ ID NO: 1352 | UUAAAUUACUCAUGUUUAUtt |
| SEQ ID NO: 1353 | GGUGUUAAAUUACUCAUGUtt |
| SEQ ID NO: 1354 | UUUUUUUUUUGGUGUUAAAtt |
| SEQ ID NO: 1355 | UUUUUUUUUUUUUUGGUGtt |
| SEQ ID NO: 1356 | UUUUUUUUUUUUUUUUUUtt |
| SEQ ID NO: 1357 | GCUGUCCGUGUCCUGGGCCtt |
| SEQ ID NO: 1358 | CAGCAUCUGCCUUUCCCUCtt |
| SEQ ID NO: 1359 | AAGGGAUGCUGUAGCCUAGtt |
| SEQ ID NO: 1360 | GGGAUGCUGUAGCCUAGCAtt |
| SEQ ID NO: 1361 | GCACAUCCAAGCGUGCUCUtt |
| SEQ ID NO: 1362 | GCGUGCUCUCCCCUCUCCUtt |
| SEQ ID NO: 1363 | CACACAUACACCCUGGGCUtt |
| SEQ ID NO: 1364 | AUGACGGCGGUUCCCCUCAtt |
| SEQ ID NO: 1365 | UCCACGCUUCCUGGAAGGUtt |
| SEQ ID NO: 1366 | GGUGAGUGGCUGGGCUCACtt |
| SEQ ID NO: 1367 | GGCGGCGGCCGCGUUCGCAtt |
| SEQ ID NO: 1368 | GGGAAGGAUAAUCUGGAGAtt |
| SEQ ID NO: 1369 | GGAUAAUCUGGAGAGGGAUtt |
| SEQ ID NO: 1370 | UCUGGAGAGGGAUCCCUCAtt |
| SEQ ID NO: 1371 | GACUCCAACCAUUUUAUAAtt |
| SEQ ID NO: 1372 | CCAUUUUAUAAUGGAAUCUtt |
| SEQ ID NO: 1373 | UGGAAUCUUUAUUUUGUGAtt |
| SEQ ID NO: 1374 | UCUUUAUUUUGUGAAAGUAtt |
| SEQ ID NO: 1375 | AGUAGCGGGGACUCAUCUCtt |
| SEQ ID NO: 1376 | GGAGUUCCUCGGGGCCCCAtt |
| SEQ ID NO: 1377 | CAGCCAGCACUCUUCUCCUtt |
| SEQ ID NO: 1378 | CUCCAUCAAGGUGGAGAUGtt |
| SEQ ID NO: 1379 | GGUGGAGAUGUACAGCGAUtt |
| SEQ ID NO: 1380 | GCAGACUGCUGGGGCCAGAtt |
| SEQ ID NO: 1381 | AAGGACGACAGCGUGAUUGtt |
| SEQ ID NO: 1382 | GGACGACAGCGUGAUUGUGtt |
| SEQ ID NO: 1383 | GAUUCAUUGUCUGAGCCCCtt |
| SEQ ID NO: 1384 | UGGCAAGCUCAAGUGUGACtt |
| SEQ ID NO: 1385 | GCUCAAGUGUGACGUCUGCtt |
| SEQ ID NO: 1386 | GUGUGACGUCUGCGGCAUGtt |
| SEQ ID NO: 1387 | CGUGCUCAUGGUGCACAAGtt |
| SEQ ID NO: 1388 | GCGCAGUCACACUGGUGAAtt |
| SEQ ID NO: 1389 | AGGCCCUUCCAUUGCAACCtt |
| SEQ ID NO: 1390 | CCAGUGUGGUGCCUCCUUCtt |
| SEQ ID NO: 1391 | GGGGAACCUGCUGCGCCACtt |
| SEQ ID NO: 1392 | CCUGCUGCCACAUCAAGtt |
| SEQ ID NO: 1393 | GCUGCACUCUGGGGAGAAGtt |
| SEQ ID NO: 1394 | GCCCUUUAAAUGUCCCUUCtt |
| SEQ ID NO: 1395 | AUGUCCCUUCUGCAACUAUtt |
| SEQ ID NO: 1396 | CUAUGCCUGCCGCCGGCGUtt |
| SEQ ID NO: 1397 | GCCCUACAAGUGUAACUACtt |
| SEQ ID NO: 1398 | GUGUAACUACUGUGGCCGGtt |
| SEQ ID NO: 1399 | CUACUGUGGCCGGAGCUACtt |
| SEQ ID NO: 1400 | ACAGCAGAGUACCCUGGAGtt |

TABLE 7-continued

Candidate siRNAs for IKZF4, SEQ ID NOs: 1121-1592 are based on NM_022465.

| | |
|---|---|
| SEQ ID NO: 1401 | GGAGCGGUGCCAUAACUACtt |
| SEQ ID NO: 1402 | CUACCUACAGAGUCUCAGCtt |
| SEQ ID NO: 1403 | GCCCAAGCUUUGGCUGGCCtt |
| SEQ ID NO: 1404 | GCUUUGGCUGGCCAACCAGtt |
| SEQ ID NO: 1405 | CCAGGUGACGAAAUACGUGtt |
| SEQ ID NO: 1406 | AUACGUGACCUGGAGAUGGtt |
| SEQ ID NO: 1407 | CUUUCAUCGAUCGUCUGGCtt |
| SEQ ID NO: 1408 | UAGCCUCACCAAACGCAAGtt |
| SEQ ID NO: 1409 | ACGCAAGCGUUCCACACCCtt |
| SEQ ID NO: 1410 | GCGUUCCACACCCCAGAAGtt |
| SEQ ID NO: 1411 | GUUUGUAGGCGAAAAGCAGtt |
| SEQ ID NO: 1412 | AAGCAGAUGCGCUUCAGCCtt |
| SEQ ID NO: 1413 | GCAGAUGCGCUUCAGCCUCtt |
| SEQ ID NO: 1414 | CUCGGGUGGCUAUGAAAAGtt |
| SEQ ID NO: 1415 | AAGGAUGUGGAGUUGGUGGtt |
| SEQ ID NO: 1416 | GGAUGUGGAGUUGGUGGCAtt |
| SEQ ID NO: 1417 | GUUCCCUGGCCUUUGUGGGtt |
| SEQ ID NO: 1418 | UUGCAUCUCAGAACUCACGtt |
| SEQ ID NO: 1419 | CUCACGCCUGUCAUCAGCUtt |
| SEQ ID NO: 1420 | GCAGGUGAGGGACCUGAGGtt |
| SEQ ID NO: 1421 | UGGCUGCCAGGACUCCACAtt |
| SEQ ID NO: 1422 | AGCAACCACGAAGAUCGGGtt |
| SEQ ID NO: 1423 | CCACGAAGAUCGGGUUGCGtt |
| SEQ ID NO: 1424 | GAUCGGGUUGCGGGGGUGGtt |
| SEQ ID NO: 1425 | AGAGGACCCCAAGCCACAGtt |
| SEQ ID NO: 1426 | GCCACAGGAGGGGUUAUUGtt |
| SEQ ID NO: 1427 | GGAAGUGCUUCGGGUGGUGtt |
| SEQ ID NO: 1428 | GUGCUUCGGGUGGUGGGCGtt |
| SEQ ID NO: 1429 | GGCCUUCAAGUGUGAGCACtt |
| SEQ ID NO: 1430 | GUGUGAGCACUGCCGUAUCtt |
| SEQ ID NO: 1431 | CAUCUGUGGUUAUCACAGCtt |
| SEQ ID NO: 1432 | UUCUCUUCCCACAUUGUCCtt |
| SEQ ID NO: 1433 | GGUGGGCUAGCAACCUCUCtt |
| SEQ ID NO: 1434 | CCUCUCCCUCUCUCCUCAGtt |
| SEQ ID NO: 1435 | GGAGUUUUGCUUUGUAGCCtt |
| SEQ ID NO: 1436 | GCAUUGUGAUGAAACAGAUtt |
| SEQ ID NO: 1437 | ACAGAUCUUUUGCUUAUGUtt |
| SEQ ID NO: 1438 | UUAGUUGAUUUAUUUUUGCtt |
| SEQ ID NO: 1439 | AUUUUAACUUAUAUCAGUCtt |
| SEQ ID NO: 1440 | CUUAUAUCAGUCACUUGCCtt |
| SEQ ID NO: 1441 | CUCCUUUCCACUUUAGGCtt |
| SEQ ID NO: 1442 | UUUUUCUCUCUUAGAUCUUtt |
| SEQ ID NO: 1443 | GCUCCUCUUAGUACUAAGAtt |
| SEQ ID NO: 1444 | GAGACUUCAAGCUUCUUGCtt |
| SEQ ID NO: 1445 | GCUUCUUGCUUUAAGUCCUtt |
| SEQ ID NO: 1446 | GUCCUCACCCUUUACAUUAtt |
| SEQ ID NO: 1447 | UUCUUCAGUUUUGAUGCUGtt |
| SEQ ID NO: 1448 | CCUGGUACUCCAUACCUCUtt |
| SEQ ID NO: 1449 | UGAAUGAAGAAUUAUUUCCtt |
| SEQ ID NO: 1450 | UGAAGAAUUAUUUCCUCAUtt |
| SEQ ID NO: 1451 | GAAUUAUUUCCUCAUUUGGtt |
| SEQ ID NO: 1452 | UUAUUUCCUCAUUUGGAAGtt |
| SEQ ID NO: 1453 | GUAGGAGGGACUGAAGAAAtt |
| SEQ ID NO: 1454 | GAAAUUCUCCCCAGGCACUtt |
| SEQ ID NO: 1455 | AUUCUCCCCAGGCACUGUGtt |
| SEQ ID NO: 1456 | UAGGUCAUAUUCCCCUAGUtt |
| SEQ ID NO: 1457 | UAUGAGUUCUCAAAGCCUAtt |
| SEQ ID NO: 1458 | AGCCUACAUUCAGGAUCUCtt |
| SEQ ID NO: 1459 | CUACCCCUCCACACGCUCUtt |
| SEQ ID NO: 1460 | CCUACCGGUCUAUUAAGUGtt |
| SEQ ID NO: 1461 | GUGGUGGCUUUUCUCUCCUtt |
| SEQ ID NO: 1462 | UUUUAUAUUCUCAGGGGCCtt |
| SEQ ID NO: 1463 | GGCUAGGUCUGCAACCCUCtt |
| SEQ ID NO: 1464 | CCCUCUGUCUCUGACAGAUtt |
| SEQ ID NO: 1465 | UUGGGAACCAGGGCAUGGGtt |
| SEQ ID NO: 1466 | CCAGGGCAUGGGAAAGGAGtt |
| SEQ ID NO: 1467 | AGGAGUGGGUCAAAAUUCUtt |
| SEQ ID NO: 1468 | AAUUCUUCUCUUUCUCCUCtt |
| SEQ ID NO: 1469 | UUCUUCUCUUUCUCCUCCAtt |
| SEQ ID NO: 1470 | ACUUCUUCACUAUAGUGACtt |
| SEQ ID NO: 1471 | ACUAGUGGGUUGCUGCCGUtt |
| SEQ ID NO: 1472 | GGGGUUGUUUCAGCCCCUCtt |
| SEQ ID NO: 1473 | ACGGGUAUCUCUUUUCUCUtt |
| SEQ ID NO: 1474 | UUUUCAGUAUAACCAAAAAtt |
| SEQ ID NO: 1475 | CCAAAAAUUAUCCCAGCAUtt |
| SEQ ID NO: 1476 | AAAUUAUCCCAGCAUGAGCtt |
| SEQ ID NO: 1477 | AUUAUCCCAGCAUGAGCACtt |

TABLE 7-continued

Candidate siRNAs for IKZF4, SEQ ID NOs: 1121-1592 are based on NM_022465.

| SEQ ID NO: 1478 | GACUGGGAUGGGUACAACUtt |
| SEQ ID NO: 1479 | CUGAACUGGGGUCUUCCUUtt |
| SEQ ID NO: 1480 | CUGGGGUCUUCCUUUACUAtt |
| SEQ ID NO: 1481 | CCUAGGAUUAGUGAGAAGGtt |
| SEQ ID NO: 1482 | GGGGCAGAAGGAGAUACAAtt |
| SEQ ID NO: 1483 | GGAGAUACAACUCCACUGCtt |
| SEQ ID NO: 1484 | CUCCACUGCAAGUGGAGGUtt |
| SEQ ID NO: 1485 | GUGGAGGUUUCUUUCUACAtt |
| SEQ ID NO: 1486 | GAGUUUUCUGCCCAAGGCCtt |
| SEQ ID NO: 1487 | GGCCACAGCCAUCCCACUCtt |
| SEQ ID NO: 1488 | ACCAAAGGCUGUUUUUCUAtt |
| SEQ ID NO: 1489 | AGGCUGUUUUUCUAUGUUUtt |
| SEQ ID NO: 1490 | AGAAAAAAAAAGUAAAAAtt |
| SEQ ID NO: 1491 | AAAAAAAGUAAAAACCAAtt |
| SEQ ID NO: 1492 | AAAAAGUAAAAACCAAACtt |
| SEQ ID NO: 1493 | AAAAGUAAAAACCAAACACtt |
| SEQ ID NO: 1494 | AAGUAAAAACCAAACACAAtt |
| SEQ ID NO: 1495 | GUAAAAACCAAACACAACAtt |
| SEQ ID NO: 1496 | AAACCAAACACAACACCUCtt |
| SEQ ID NO: 1497 | ACCAAACACAACACCUCACtt |
| SEQ ID NO: 1498 | ACACAACACCUCACAAGUUtt |
| SEQ ID NO: 1499 | CACCUCACAAGUUGUAACUtt |
| SEQ ID NO: 1500 | GUUGUAACUCUUGGUCCUUtt |
| SEQ ID NO: 1501 | CUCUUGGUCCUUCUCUCUCtt |
| SEQ ID NO: 1502 | AGGGUGGGCUAAGGAACAGtt |
| SEQ ID NO: 1503 | GGAACAGACCCUGGGAUUAtt |
| SEQ ID NO: 1504 | CAGACCCUGGGAUUAGGGCtt |
| SEQ ID NO: 1505 | GGGCUCUGAGAGGAGUCUAtt |
| SEQ ID NO: 1506 | GGGAGACCCUAAAAAACUUtt |
| SEQ ID NO: 1507 | AAAACUUUCUCCUCUUUGUtt |
| SEQ ID NO: 1508 | AACUUUCUCCUCUUUGUCCtt |
| SEQ ID NO: 1509 | CUUUCUCCUCUUUGUCCUCtt |
| SEQ ID NO: 1510 | GAGAACCAGAUUGGCAGGGtt |
| SEQ ID NO: 1511 | CCAGAUUGGCAGGGAGAAGtt |
| SEQ ID NO: 1512 | GCAUUGUGGGGCAAUUGUUtt |
| SEQ ID NO: 1513 | UUGUUCCUCCUUGACAAUGtt |
| SEQ ID NO: 1514 | UGUAGCAAUAAAUAGAUGCtt |
| SEQ ID NO: 1515 | UAAAUAGAUGCUGCCAAGGtt |
| SEQ ID NO: 1516 | AUAGAUGCUGCCAAGGGCAtt |
| SEQ ID NO: 1517 | GGGCAGAAAAUGGGGAGGUtt |
| SEQ ID NO: 1518 | AAUGGGGAGGUUAGCUCAGtt |
| SEQ ID NO: 1519 | UGGGGAGGUUAGCUCAGAGtt |
| SEQ ID NO: 1520 | AGGAAGAAUCCUCAACGGCtt |
| SEQ ID NO: 1521 | GAAUCCUCAACGGCACCCUtt |
| SEQ ID NO: 1522 | UCCUCAACGGCACCCUGGGtt |
| SEQ ID NO: 1523 | CGGCACCCUGGGGUGCUAGtt |
| SEQ ID NO: 1524 | UGUCAGCAGAGCUGAGAUUtt |
| SEQ ID NO: 1525 | UAUCUGGGCUUUUCCUGAAtt |
| SEQ ID NO: 1526 | CUAUUCUGGUUAUUGAGCCtt |
| SEQ ID NO: 1527 | GGACUAGUCCCUUCUGGGGtt |
| SEQ ID NO: 1528 | CUGUGGCACCUGUAACCUCtt |
| SEQ ID NO: 1529 | CCUCCCGGAACAUGAAGGAtt |
| SEQ ID NO: 1530 | CAUGAAGGACUAUGCUCUGtt |
| SEQ ID NO: 1531 | GGACUAUGCUCUGAGGCUAtt |
| SEQ ID NO: 1532 | GGGCAAGACCAGGUGCUAAtt |
| SEQ ID NO: 1533 | GACCAGGUGCUAAGGAGGGtt |
| SEQ ID NO: 1534 | GGAGGGGAGAGGGGCAUCtt |
| SEQ ID NO: 1535 | CCAGGGUCUUAGGUACAAAtt |
| SEQ ID NO: 1536 | AAUCCUACUUUUCAGAGCCtt |
| SEQ ID NO: 1537 | UCCUACUUUUCAGAGCCUUtt |
| SEQ ID NO: 1538 | CCUCAAACAUCCUCAUGCUtt |
| SEQ ID NO: 1539 | ACAUCCUCAUGCUCUCUCCtt |
| SEQ ID NO: 1540 | AAAAAAAGUAAAGAAAAAtt |
| SEQ ID NO: 1541 | AAAAAAGUAAAGAAAAAGAtt |
| SEQ ID NO: 1542 | AAAAGUAAAGAAAAAGAAAtt |
| SEQ ID NO: 1543 | AAGUAAAGAAAAGAAAAAtt |
| SEQ ID NO: 1544 | GUAAAGAAAAGAAAAAAAtt |
| SEQ ID NO: 1545 | AGAAAAAGAAAAAAAAAUAtt |
| SEQ ID NO: 1546 | AAAGAAAAAAAAUACACAtt |
| SEQ ID NO: 1547 | AGAAAAAAAAUACACACAtt |
| SEQ ID NO: 1548 | AAAAAAUACACACACACUtt |
| SEQ ID NO: 1549 | AAAAUACACACACUGAAtt |
| SEQ ID NO: 1550 | AAAUACACACACUGAAAtt |
| SEQ ID NO: 1551 | AUACACACACUGAAACCtt |
| SEQ ID NO: 1552 | ACCCACAUGGAGAAAAGAGtt |
| SEQ ID NO: 1553 | AAGAGGUGUUUCCUUUUAUtt |
| SEQ ID NO: 1554 | GAGGUGUUUCCUUUUAUAUtt |

TABLE 7-continued

Candidate siRNAs for IKZF4, SEQ ID NOs: 1121-1592 are based on NM_022465.

| SEQ ID NO: 1555 | AAUCAAUACCACCAACAAAUtt |
| --- | --- |
| SEQ ID NO: 1556 | UCAAUACCACCAACAAAAUtt |
| SEQ ID NO: 1557 | UACCACCAACAAAAUAUUUtt |
| SEQ ID NO: 1558 | CAAAAUAUUUCUAAGUAGAtt |
| SEQ ID NO: 1559 | AAUAUUUCUAAGUAGACACtt |
| SEQ ID NO: 1560 | UAUUUCUAAGUAGACACUUtt |
| SEQ ID NO: 1561 | GUAGACACUUUUCCAGACCtt |
| SEQ ID NO: 1562 | GCUGCAGAUAGGAUUUUGUtt |
| SEQ ID NO: 1563 | UACUUCUGGCAGCUUCUUUtt |
| SEQ ID NO: 1564 | UAUAUAUAUAUACAUAUAUtt |
| SEQ ID NO: 1565 | UCAGAAGUUAUGAAGAACAtt |
| SEQ ID NO: 1566 | GUUAUGAAGAACAAAAAGAtt |
| SEQ ID NO: 1567 | GAACAAAAGAAAAAAUAAtt |
| SEQ ID NO: 1568 | CAAAAAGAAAAAAUAAACAtt |
| SEQ ID NO: 1569 | AAAGAAAAAAUAAACACAGtt |
| SEQ ID NO: 1570 | AGAAAAAAUAAACACAGAAtt |
| SEQ ID NO: 1571 | AAAAUAAACACAGAAGCAAtt |
| SEQ ID NO: 1572 | AAUAAACACAGAAGCAAGUtt |
| SEQ ID NO: 1573 | UAAACACAGAAGCAAGUGCtt |
| SEQ ID NO: 1574 | ACACAGAAGCAAGUGCAAUtt |
| SEQ ID NO: 1575 | GCAAGUGCAAUACCACCUCtt |
| SEQ ID NO: 1576 | GUGCAAUACCACCUCUCUUtt |
| SEQ ID NO: 1577 | UACCACCUCUCUUCUCCCUtt |
| SEQ ID NO: 1578 | AGAGUUUUCUCCCUUUCUCtt |
| SEQ ID NO: 1579 | GGGGAGUUAAACUAGCUUUtt |
| SEQ ID NO: 1580 | ACUAGCUUUUGAGACUUAUtt |
| SEQ ID NO: 1581 | AGCAUUUUGUAUAUGUAAUtt |
| SEQ ID NO: 1582 | UAUAUUGUAAGUAAAUAUUtt |
| SEQ ID NO: 1583 | GUAAAUAUUUGUGUAACGGtt |
| SEQ ID NO: 1584 | AUAUUUGUGUAACGGAGAUtt |
| SEQ ID NO: 1585 | CGGAGAUAUACUACUGUAAtt |
| SEQ ID NO: 1586 | GUUUUGUACUGUACUGGCUtt |
| SEQ ID NO: 1587 | AGUCUGUUUAUAAAUAAACtt |
| SEQ ID NO: 1588 | AUAAACAUGAGUAAUUUAAtt |
| SEQ ID NO: 1589 | ACAUGAGUAAUUUAACACCtt |
| SEQ ID NO: 1590 | UUUAACACCAAAAAAAAAAtt |
| SEQ ID NO: 1591 | CACCAAAAAAAAAAAAAAAtt |
| SEQ ID NO: 1592 | AAAAAAAAAAAAAAAAAAAtt |

TABLE 8

Candidate siRNAs for RAB5B, SEQ ID NOs: 1593-1912 are based on NM_002868.

| SEQ ID NO: 1593 | GGGGAGGGGAUUUCCAGGCtt |
| --- | --- |
| SEQ ID NO: 1594 | AGGGGGAAGGGGAGGGGAUtt |
| SEQ ID NO: 1595 | UCUGCUAGUCAUGGCCAGAtt |
| SEQ ID NO: 1596 | CCAUUGGGCCUAGCUGUGCtt |
| SEQ ID NO: 1597 | GCUGGCCUGGGGUUGCCCAtt |
| SEQ ID NO: 1598 | AAAUUUGCUGGCCUGGGGtt |
| SEQ ID NO: 1599 | CAAUUUGAACUGGCAAAUUtt |
| SEQ ID NO: 1600 | ACCAAUUUGAACUGGCAAAtt |
| SEQ ID NO: 1601 | UUCUCCCAGCAGGACCAAUtt |
| SEQ ID NO: 1602 | UUGACUUUCCCACUGCAGAtt |
| SEQ ID NO: 1603 | CGUAAUACCAGGCUUGACUtt |
| SEQ ID NO: 1604 | ACAAAACGUAAUACCAGGCtt |
| SEQ ID NO: 1605 | GUACUCAUGGAACUGCCCUtt |
| SEQ ID NO: 1606 | CAGAUCUCAAACUUCACUGtt |
| SEQ ID NO: 1607 | UGUGUCCCAGAUCUCAAACtt |
| SEQ ID NO: 1608 | CGUAAACCACGAUUGCAGCtt |
| SEQ ID NO: 1609 | GUAAUGUCGUAAACCACGAtt |
| SEQ ID NO: 1610 | UCGGGCAAAGGUUUCCUGAtt |
| SEQ ID NO: 1611 | UCUUUGCUCGGGCAAAGGUtt |
| SEQ ID NO: 1612 | AGUUCCUUCACCCAUGUCUtt |
| SEQ ID NO: 1613 | GGCCUGUCGCUGUAGUUCCtt |
| SEQ ID NO: 1614 | GACUGGCCUGUCGCUGUAGtt |
| SEQ ID NO: 1615 | GUUGGCCAGGUCAGCUUUGtt |
| SEQ ID NO: 1616 | UUUGUUGGCCAGGUCAGCUtt |
| SEQ ID NO: 1617 | AUACUCCACCAUACGUUUGtt |
| SEQ ID NO: 1618 | UUCAUACUCCACCAUACGUtt |
| SEQ ID NO: 1619 | CUGCAUAUGCCUGGGCCUCtt |
| SEQ ID NO: 1620 | CUCCAUGAACAAUAAGCUGtt |
| SEQ ID NO: 1621 | AUUCACGUUCAUAGCUGUCtt |
| SEQ ID NO: 1622 | CAGGAAGAGAUCAUUCACGtt |
| SEQ ID NO: 1623 | UAUGCCAGGAAGAGAUCAUtt |
| SEQ ID NO: 1624 | UUUGGCAACUUCUUAGCUAtt |
| SEQ ID NO: 1625 | UUCACUCUUUGGCAACUUCtt |
| SEQ ID NO: 1626 | GGGUUCACUCUUUGGCAACtt |
| SEQ ID NO: 1627 | AGAUUCUGGGGUUCACUCUtt |
| SEQ ID NO: 1628 | CACCUCCCAGAUUCUGGGGtt |
| SEQ ID NO: 1629 | GCCUGCUGCACCUCCCAGAtt |
| SEQ ID NO: 1630 | UGGAGAUCCACACCCCGGCtt |
| SEQ ID NO: 1631 | UCUUGUUCUGCUGGGACUGtt |

TABLE 8-continued

Candidate siRNAs for RAB5B, SEQ ID NOs: 1593-1912 are based on NM_002868.

| SEQ ID NO: 1632 | GCUACAACACUGGCUCUUGtt |
| --- | --- |
| SEQ ID NO: 1633 | GUUGCUACAACACUGGCUCtt |
| SEQ ID NO: 1634 | CUGCUAGCCACCCCCUCAGtt |
| SEQ ID NO: 1635 | GUGCUAGCUCCAUACUUGUtt |
| SEQ ID NO: 1636 | UCUUGUGCUAGCUCCAUACtt |
| SEQ ID NO: 1637 | GGAGGUUAUUUCUUAGCUCtt |
| SEQ ID NO: 1638 | UAGGGAUGGAGGUUAUUUCtt |
| SEQ ID NO: 1639 | GGGUAGGGAUGGAGGUUAUtt |
| SEQ ID NO: 1640 | UGAGGGGUAGGGAUGGAGGtt |
| SEQ ID NO: 1641 | UGUGCUGUUACCGUAGGGGtt |
| SEQ ID NO: 1642 | GCCAGGGCUCAGUGUGCUGtt |
| SEQ ID NO: 1643 | AGCUGUCAGGAGGCAGCCCtt |
| SEQ ID NO: 1644 | GGUGUUUGUUGCUGAAGCGtt |
| SEQ ID NO: 1645 | AACAGCUGCCUGGUGUUUGtt |
| SEQ ID NO: 1646 | GGCAACAGCUGCCUGGUGUtt |
| SEQ ID NO: 1647 | AGGUAAGUCCUGGGGGGAGtt |
| SEQ ID NO: 1648 | AAAGUGAAGAAAGUUUGUUtt |
| SEQ ID NO: 1649 | ACAAAGUGAAGAAAGUUUGtt |
| SEQ ID NO: 1650 | AAUACAAAGUGAAGAAAGUtt |
| SEQ ID NO: 1651 | AGAUACGUAAGUCGCUGUCtt |
| SEQ ID NO: 1652 | GACAGGAGUCAGAAGUGUUtt |
| SEQ ID NO: 1653 | GGGACAGGAGUCAGAAGUGtt |
| SEQ ID NO: 1654 | AGUUCCUGGGUUCACCACUtt |
| SEQ ID NO: 1655 | UCCUUCCUCAGUUCCUGGtt |
| SEQ ID NO: 1656 | UGGAAACCUCCUUCCUCAGtt |
| SEQ ID NO: 1657 | AAAUGAACUGGAAACCUCCtt |
| SEQ ID NO: 1658 | UUAUUCUCCCCCAGGGCCCtt |
| SEQ ID NO: 1659 | CCUCCUGCUCUGAGCUUUAtt |
| SEQ ID NO: 1660 | CUCCCUCCUGCUCUGAGCUtt |
| SEQ ID NO: 1661 | ACAAAAGGAAAUGUUUCCtt |
| SEQ ID NO: 1662 | AAAAACAAAAGGAAAUGUtt |
| SEQ ID NO: 1663 | UCAUGGAUACCGCAAUGUUtt |
| SEQ ID NO: 1664 | AAUCAUGGAUACCGCAAUGtt |
| SEQ ID NO: 1665 | CUGAGAUCUUGCCUCCCCAtt |
| SEQ ID NO: 1666 | CUGCCUGGUGCCUGAGAUCtt |
| SEQ ID NO: 1667 | CCACCUCCGCCCAGUUAGCtt |
| SEQ ID NO: 1668 | CACCUCCACCUCCGCCCAGtt |
| SEQ ID NO: 1669 | AAGAGUUACAGAGCCACAGtt |
| SEQ ID NO: 1670 | AAACUGGGCCUUUGAAGAGtt |
| SEQ ID NO: 1671 | GUGAGGGGAAACUGGGCCUtt |
| SEQ ID NO: 1672 | UGGGGUCCAACCCCCACGAtt |
| SEQ ID NO: 1673 | GGCAACCAGUGAAAAUUCUtt |
| SEQ ID NO: 1674 | UGCAGGCAACCAGUGAAAAtt |
| SEQ ID NO: 1675 | CCAACUGAACUACCAUCAAtt |
| SEQ ID NO: 1676 | CAAGUAAAUCAAUCAAAACtt |
| SEQ ID NO: 1677 | AACCUCAGAUUUCAUUGAAtt |
| SEQ ID NO: 1678 | GCAUUAACCUCAGAUUUCAtt |
| SEQ ID NO: 1679 | CCUCGCAUUAACCUCAGAUtt |
| SEQ ID NO: 1680 | CCUCUCCUCGAACCUCGCAtt |
| SEQ ID NO: 1681 | GUAGCUGCCACUGGUAGUUtt |
| SEQ ID NO: 1682 | GAGUAGCUGCCACUGGUAGtt |
| SEQ ID NO: 1683 | CUAACAGUGGAGAUAGGACtt |
| SEQ ID NO: 1684 | UAUAGGUUAAUAAUUAGAGtt |
| SEQ ID NO: 1685 | CAAGAAUAUAGGUUAAUAAtt |
| SEQ ID NO: 1686 | AGCUUGGCAAGAAUAUAGGtt |
| SEQ ID NO: 1687 | CCUAUAGUCAAUAGUUAGCtt |
| SEQ ID NO: 1688 | GCAAACCUAUAGUCAAUAGtt |
| SEQ ID NO: 1689 | UCCUCAAUUGCUCAAUUAAtt |
| SEQ ID NO: 1690 | ACACUCCUCAAUUGCUCAAtt |
| SEQ ID NO: 1691 | AUCCUGAGACACUCCUCAAtt |
| SEQ ID NO: 1692 | UCCUUUUUACUCCCCUACCtt |
| SEQ ID NO: 1693 | CUUUUGCCUGACCUCCUUUtt |
| SEQ ID NO: 1694 | CCCUUUUGCCUGACCUCCUtt |
| SEQ ID NO: 1695 | GACAGAAAACUCCUCCCUUtt |
| SEQ ID NO: 1696 | AGGACAGAAAACUCCUCCCtt |
| SEQ ID NO: 1697 | CAUGGUAAUGGAUAUCAAAtt |
| SEQ ID NO: 1698 | GAAUAAAGAUCAUACCUAUtt |
| SEQ ID NO: 1699 | AGGGACUAAAUUCAAGAUAtt |
| SEQ ID NO: 1700 | UAAGGAUGGAGGGACUAAAtt |
| SEQ ID NO: 1701 | AUGGGGAGGGAUGGGGGGAtt |
| SEQ ID NO: 1702 | ACAUGGAUUAAACCACUGGtt |
| SEQ ID NO: 1703 | GCCCCUAUUGGUACAUGGAtt |
| SEQ ID NO: 1704 | UCUGUGGUACUAGCCCCUAtt |
| SEQ ID NO: 1705 | GUACCUUCAGUGCCGGUCAtt |
| SEQ ID NO: 1706 | GAGCCAGUUGUAAGGUACCtt |
| SEQ ID NO: 1707 | CUCUGAUAAUAUGAGCCAGtt |
| SEQ ID NO: 1708 | AUGAAGAGAGACUAGAGAUtt |

TABLE 8-continued

Candidate siRNAs for RAB5B, SEQ ID NOs: 1593-1912 are based on NM_002868.

| SEQ ID NO: 1709 | AUGGCUUCUCAGAGACAUCtt |
| --- | --- |
| SEQ ID NO: 1710 | UCUCUUUUGCCUUGAUGGCtt |
| SEQ ID NO: 1711 | CUUAAAGUUCUCUUUUGCCtt |
| SEQ ID NO: 1712 | AGGAACUUAAAGUUCUCUUtt |
| SEQ ID NO: 1713 | CAAGGAACUUAAAGUUCUCtt |
| SEQ ID NO: 1714 | UGGAACAAGGAACUUAAAGtt |
| SEQ ID NO: 1715 | CCGGGCUGGAACAAGGAACtt |
| SEQ ID NO: 1716 | UGACCUUUCCUUUCUUUCUtt |
| SEQ ID NO: 1717 | ACUGUGACCUUUCCUUUCUtt |
| SEQ ID NO: 1718 | GGUCACUGUGACCUUUCCUtt |
| SEQ ID NO: 1719 | UCCUAGGUCACUGUGACCUtt |
| SEQ ID NO: 1720 | AGCCAAAAGGGCAGGAAGGtt |
| SEQ ID NO: 1721 | UUCAUAGAUUUCUCAGCUGtt |
| SEQ ID NO: 1722 | GAAUCUCAGCUUCAUAGAUtt |
| SEQ ID NO: 1723 | GGUCCUUCAGAAUCUCAGCtt |
| SEQ ID NO: 1724 | AAGAACCUAAGCUGGGUCCtt |
| SEQ ID NO: 1725 | CCCUGGAAAAGGAAGGGAAtt |
| SEQ ID NO: 1726 | AAGGGGGAAAUGUGUGUGUtt |
| SEQ ID NO: 1727 | GCUAUGGGGGGCCAGUGGCtt |
| SEQ ID NO: 1728 | GCCAUCCUAGUUCUUCCACtt |
| SEQ ID NO: 1729 | UGGAAAGCCAUCCUAGUUCtt |
| SEQ ID NO: 1730 | CUUUGGAAAGCCAUCCUAGtt |
| SEQ ID NO: 1731 | ACUUCAUUUCUAGAAGACUtt |
| SEQ ID NO: 1732 | CACAGAGAAAGAACUUCAUtt |
| SEQ ID NO: 1733 | AGCUGCACAGAGAAAGAACtt |
| SEQ ID NO: 1734 | CCCAAGAUAAUGAAACAUCtt |
| SEQ ID NO: 1735 | AGAAGCCUGGGGAAGUGGUtt |
| SEQ ID NO: 1736 | AAGCUAAGGCCAAAUCCUGtt |
| SEQ ID NO: 1737 | AAAACCACAACACCCCCCCtt |
| SEQ ID NO: 1738 | AGGAAGAAAGGCAAAUGCUtt |
| SEQ ID NO: 1739 | UGUUACCACGAUUGUUAUGtt |
| SEQ ID NO: 1740 | CAUUCUGUUACCACGAUUGtt |
| SEQ ID NO: 1741 | UCGCAUUCUGUUACCACGAtt |
| SEQ ID NO: 1742 | AAUCAGCAGUCGCAUUCUGtt |
| SEQ ID NO: 1743 | CGGUAAAUCAGCAGUCGCAtt |
| SEQ ID NO: 1744 | UUUCCUUUUUUUACUUACAtt |
| SEQ ID NO: 1745 | CUUUUUUUCCUUUUUUUACtt |
| SEQ ID NO: 1746 | UUUUCUUUUUUUCCUUUUUtt |
| SEQ ID NO: 1747 | UUUUUUCUUUUUUUCCUUUtt |
| SEQ ID NO: 1748 | UUUUUUUUCUUUUUUUCCtt |
| SEQ ID NO: 1749 | UUUUUUUUUUUUUCUUUUUtt |
| SEQ ID NO: 1750 | UUUUUUUUUUUUUUCUUUUtt |
| SEQ ID NO: 1751 | UUUUUUUUUUUUUUUUCUtt |
| SEQ ID NO: 1752 | UUUUUUUUUUUUUUUUUUtt |
| SEQ ID NO: 1753 | GCCUGGAAAUCCCCUCCCCtt |
| SEQ ID NO: 1754 | AUCCCCUCCCCUUCCCCCUtt |
| SEQ ID NO: 1755 | UCUGGCCAUGACUAGCAGAtt |
| SEQ ID NO: 1756 | GCACAGCUAGGCCCAAUGGtt |
| SEQ ID NO: 1757 | UGGGCAACCCCAGGCCAGCtt |
| SEQ ID NO: 1758 | CCCCAGGCCAGCAAAAUUUtt |
| SEQ ID NO: 1759 | AAUUUGCCAGUUCAAAUUGtt |
| SEQ ID NO: 1760 | UUUGCCAGUUCAAAUUGGUtt |
| SEQ ID NO: 1761 | AUUGGUCCUGCUGGGAGAAtt |
| SEQ ID NO: 1762 | UCUGCAGUGGGAAAGUCAAtt |
| SEQ ID NO: 1763 | AGUCAAGCCUGGUAUUACGtt |
| SEQ ID NO: 1764 | GCCUGGUAUUACGUUUUGUtt |
| SEQ ID NO: 1765 | AGGGCAGUUCCAUGAGUACtt |
| SEQ ID NO: 1766 | CAGUGAAGUUUGAGAUCUGtt |
| SEQ ID NO: 1767 | GUUUGAGAUCGGGACACAtt |
| SEQ ID NO: 1768 | GCUGCAAUCGUGGUUUACGtt |
| SEQ ID NO: 1769 | UCGUGGUUUACGACAUUACtt |
| SEQ ID NO: 1770 | UCAGGAAACCUUUGCCCGAtt |
| SEQ ID NO: 1771 | ACCUUUGCCCGAGCAAAGAtt |
| SEQ ID NO: 1772 | AGACAUGGGUGAAGGAACUtt |
| SEQ ID NO: 1773 | GGAACUACAGCGACAGGCCtt |
| SEQ ID NO: 1774 | CUACAGCGACAGGCCAGUCtt |
| SEQ ID NO: 1775 | CAAAGCUGACCUGGCCAACtt |
| SEQ ID NO: 1776 | AGCUGACCUGGCCAACAAAtt |
| SEQ ID NO: 1777 | CAAACGUAUGGUGGAGUAUtt |
| SEQ ID NO: 1778 | ACGUAUGGUGGAGUAUGAAtt |
| SEQ ID NO: 1779 | GAGGCCCAGGCAUAUGCAGtt |
| SEQ ID NO: 1780 | CAGCUUAUUGUUCAUGGAGtt |
| SEQ ID NO: 1781 | GACAGCUAUGAACGUGAAUtt |
| SEQ ID NO: 1782 | CGUGAAUGAUCUCUUCCUGtt |
| SEQ ID NO: 1783 | UGAUCUCUUCCUGGCAAUAtt |
| SEQ ID NO: 1784 | UAGCUAAGAAGUUGCCAAAtt |
| SEQ ID NO: 1785 | GAAGUUGCCAAAGAGUGAAtt |

TABLE 8-continued

Candidate siRNAs for RAB5B, SEQ ID NOs: 1593-1912 are based on NM_002868.

| | |
|---|---|
| SEQ ID NO: 1786 | GUUGCCAAAGAGUGAACCCUtt |
| SEQ ID NO: 1787 | AGAGUGAACCCCAGAAUCUtt |
| SEQ ID NO: 1788 | CCCCAGAAUCUGGGAGGUGtt |
| SEQ ID NO: 1789 | UCUGGGAGGUGCAGCAGGCtt |
| SEQ ID NO: 1790 | GCCGGGGUGUGGAUCUCCAtt |
| SEQ ID NO: 1791 | CAGUCCCAGCAGAACAAGAtt |
| SEQ ID NO: 1792 | CAAGAGCCAGUGUUGUAGCtt |
| SEQ ID NO: 1793 | GAGCCAGUGUUUGUAGCAACtt |
| SEQ ID NO: 1794 | CUGAGGGGUGGCUAGCAGtt |
| SEQ ID NO: 1795 | ACAAGUAUGGAGCUAGCACtt |
| SEQ ID NO: 1796 | GUAUGGAGCUAGCACAAGAtt |
| SEQ ID NO: 1797 | GAGCUAAGAAAUAACCUCCtt |
| SEQ ID NO: 1798 | GAAAUAACCUCCAUCCCUAtt |
| SEQ ID NO: 1799 | AUAACCUCCAUCCCUACCCtt |
| SEQ ID NO: 1800 | CCUCCAUCCCUACCCCUCAtt |
| SEQ ID NO: 1801 | CCCCUACGGUAACAGCACAtt |
| SEQ ID NO: 1802 | CAGCACACUGAGCCCUGGCtt |
| SEQ ID NO: 1803 | GGGCUGCCUCCUGACAGCUtt |
| SEQ ID NO: 1804 | CGCUUCAGCAACAAACACCtt |
| SEQ ID NO: 1805 | CAAACACCAGGCAGCUGUUtt |
| SEQ ID NO: 1806 | ACACCAGGCAGCUGUUGCCtt |
| SEQ ID NO: 1807 | CUCCCCCCAGGACUUACCUtt |
| SEQ ID NO: 1808 | AACAAACUUUCUUCACUUUtt |
| SEQ ID NO: 1809 | CAAACUUUCUUCACUUUGUtt |
| SEQ ID NO: 1810 | ACUUUCUUCACUUUGUAUUtt |
| SEQ ID NO: 1811 | GACAGCGACUUACGUAUCUtt |
| SEQ ID NO: 1812 | AACACUUCUGACUCCUGUCtt |
| SEQ ID NO: 1813 | CACUUCUGACUCCUGUCCCtt |
| SEQ ID NO: 1814 | AGUGGUGAACCCAGGAACUtt |
| SEQ ID NO: 1815 | CCCAGGAACUGAGGAAGGAtt |
| SEQ ID NO: 1816 | CUGAGGAAGGAGGUUUCCAtt |
| SEQ ID NO: 1817 | GGAGGUUUCCAGUUCAUUUtt |
| SEQ ID NO: 1818 | GGGCCCUGGGGGAGAAUAAtt |
| SEQ ID NO: 1819 | UAAAGCUCAGAGCAGGAGGtt |
| SEQ ID NO: 1820 | AGCUCAGAGCAGGAGGGAGtt |
| SEQ ID NO: 1821 | GGAAACAUUUCCUUUUUGUtt |
| SEQ ID NO: 1822 | ACAUUCCUUUUUGUUUUUtt |
| SEQ ID NO: 1823 | AACAUUGCGGUAUCCAUGAtt |
| SEQ ID NO: 1824 | CAUUGCGGUAUCCAUGAUUtt |
| SEQ ID NO: 1825 | UGGGGAGGCAAGAUCUCAGtt |
| SEQ ID NO: 1826 | GAUCUCAGGCACCAGGCAGtt |
| SEQ ID NO: 1827 | GCUAACUGGGCGGAGGUGGtt |
| SEQ ID NO: 1828 | CUGGGCGGAGGUGGAGGUGtt |
| SEQ ID NO: 1829 | CUGUGGCUCUGUAACUCUUtt |
| SEQ ID NO: 1830 | CUCUUCAAAGGCCCAGUUUtt |
| SEQ ID NO: 1831 | AGGCCCAGUUUCCCCUCACtt |
| SEQ ID NO: 1832 | UCGUGGGGUUUGGACCCCAtt |
| SEQ ID NO: 1833 | AGAAUUUCACUGGUUGCCtt |
| SEQ ID NO: 1834 | UUUUCACUGGUUGCCUGCAtt |
| SEQ ID NO: 1835 | UUGAUGGUAGUUCAGUUGGtt |
| SEQ ID NO: 1836 | GUUUGAUUGAUUUACUUGtt |
| SEQ ID NO: 1837 | UUCAAUGAAAUCUGAGGUUtt |
| SEQ ID NO: 1838 | UGAAAUCUGAGGUUAAUGCtt |
| SEQ ID NO: 1839 | AUCUGAGGUUAAUGCGAGGtt |
| SEQ ID NO: 1840 | UGCGAGGUUCGAGGAGAGGtt |
| SEQ ID NO: 1841 | AACUACCAGUGGCAGCUACtt |
| SEQ ID NO: 1842 | CUACCAGUGGCAGCUACUCtt |
| SEQ ID NO: 1843 | GUCCUAUCUCCACUGUUAGtt |
| SEQ ID NO: 1844 | CUCUAAUUAUUAACCUAUAtt |
| SEQ ID NO: 1845 | UUAUUAACCUAUAUUCUUGtt |
| SEQ ID NO: 1846 | CCUAUAUUCUUGCCAAGCUtt |
| SEQ ID NO: 1847 | GCUAACUAUUGACUAUAGGtt |
| SEQ ID NO: 1848 | CUAUUGACUAUAGGUUGCtt |
| SEQ ID NO: 1849 | UUAAUUGAGCAAUUGAGGAtt |
| SEQ ID NO: 1850 | UUGAGCAAUUGAGGAGUGUtt |
| SEQ ID NO: 1851 | UUGAGGAGUGUCUCAGGAUtt |
| SEQ ID NO: 1852 | GGUAGGGGAGUAAAAGGAtt |
| SEQ ID NO: 1853 | AAAGGAGGUCAGGCAAAAGtt |
| SEQ ID NO: 1854 | AGGAGGUCAGGCAAAAGGtt |
| SEQ ID NO: 1855 | AAGGGAGGAGUUUUCUGUCtt |
| SEQ ID NO: 1856 | GGGAGGAGUUUUCUGUCCUtt |
| SEQ ID NO: 1857 | UUUGAUAUCCAUUACCAUGtt |
| SEQ ID NO: 1858 | AUAGGUAUGAUCUUUAUUCtt |
| SEQ ID NO: 1859 | UAUCUUGAAUUUAGUCCCUtt |
| SEQ ID NO: 1860 | UUUAGUCCCUCCAUCCUUAtt |
| SEQ ID NO: 1861 | UCCCCCCAUCCCUCCCCAUtt |
| SEQ ID NO: 1862 | CCAGUGGUUUAAUCCAUGUtt |

TABLE 8-continued

Candidate siRNAs for RAB5B, SEQ ID NOs: 1593-1912 are based on NM_002868.

| | |
|---|---|
| SEQ ID NO: 1863 | UCCAUGUACCAAUAGGGGCtt |
| SEQ ID NO: 1864 | UAGGGGCUAGUACCACAGAtt |
| SEQ ID NO: 1865 | UGACCGGCACUGAAGGUACtt |
| SEQ ID NO: 1866 | GGUACCUUACAACUGGCUCtt |
| SEQ ID NO: 1867 | CUGGCUCAUAUUAUCAGAGtt |
| SEQ ID NO: 1868 | AUCUCUAGUCUCUCUUCAUtt |
| SEQ ID NO: 1869 | GAUGUCUCUGAGAAGCCAUtt |
| SEQ ID NO: 1870 | GCCAUCAAGGCAAAAGAGAtt |
| SEQ ID NO: 1871 | GGCAAAAGAGAACUUUAAGtt |
| SEQ ID NO: 1872 | AAGAGAACUUUAAGUUCCUtt |
| SEQ ID NO: 1873 | GAGAACUUUAAGUUCCUUGtt |
| SEQ ID NO: 1874 | CUUUAAGUUCCUUGUUCCAtt |
| SEQ ID NO: 1875 | GUUCCUUGUUCCAGCCCGGtt |
| SEQ ID NO: 1876 | AGAAAGAAAGGAAAGGUCAtt |
| SEQ ID NO: 1877 | AGAAAGGAAAGGUCACAGUtt |
| SEQ ID NO: 1878 | AGGAAAGGUCACAGUGACCtt |
| SEQ ID NO: 1879 | AGGUCACAGUGACCUAGGAtt |
| SEQ ID NO: 1880 | CCUUCCUGCCCUUUUGGCUtt |
| SEQ ID NO: 1881 | CAGCUGAGAAAUCUAUGAAtt |
| SEQ ID NO: 1882 | AUCUAUGAAGCUGAGAUUCtt |
| SEQ ID NO: 1883 | GCUGAGAUUCUGAAGGACCtt |
| SEQ ID NO: 1884 | GGACCCAGCUUAGGUUCUUtt |
| SEQ ID NO: 1885 | UUCCCUUCCUUUUCCAGGGtt |
| SEQ ID NO: 1886 | ACACACACAUUCCCCCUUtt |
| SEQ ID NO: 1887 | GCCACUGGCCCCCCAUAGCtt |
| SEQ ID NO: 1888 | GUGGAAGAACUAGGAUGGCtt |
| SEQ ID NO: 1889 | GAACUAGGAUGGCUUUCCAtt |
| SEQ ID NO: 1890 | CUAGGAUGGCUUUCCAAAGtt |
| SEQ ID NO: 1891 | AGUCUUCUAGAAAUGAAGUtt |
| SEQ ID NO: 1892 | AUGAAGUUCUUUCUCUGUGtt |
| SEQ ID NO: 1893 | GUUCUUUCUCUGUGCAGCUtt |
| SEQ ID NO: 1894 | GAUGUUUCAUUAUCUUGGGtt |
| SEQ ID NO: 1895 | ACCACUUCCCCAGGCUUCUtt |
| SEQ ID NO: 1896 | CAGGAUUUGGCCUUAGCUUtt |
| SEQ ID NO: 1897 | GGGGGGGUGUUUGUGGUUUtt |
| SEQ ID NO: 1898 | AGCAUUUGCCUUUCUUCCUtt |
| SEQ ID NO: 1899 | CAUAACAAUCGUGGUAACAtt |
| SEQ ID NO: 1900 | CAAUCGUGGUAACAGAAUGtt |
| SEQ ID NO: 1901 | UCGUGGUAACAGAAUGCGAtt |
| SEQ ID NO: 1902 | CAGAAUGCGACUGCUGAUUtt |
| SEQ ID NO: 1903 | UGCGACUGCUGAUUUACCGtt |
| SEQ ID NO: 1904 | UGUAAGUAAAAAAAGGAAAtt |
| SEQ ID NO: 1905 | GUAAAAAAGGAAAAAAGtt |
| SEQ ID NO: 1906 | AAAAAGGAAAAAAGAAAAtt |
| SEQ ID NO: 1907 | AAAGGAAAAAAGAAAAAAtt |
| SEQ ID NO: 1908 | AGGAAAAAAGAAAAAAAAtt |
| SEQ ID NO: 1909 | AAAAAGAAAAAAAAAAAAtt |
| SEQ ID NO: 1910 | AAAGAAAAAAAAAAAAAAtt |
| SEQ ID NO: 1911 | AGAAAAAAAAAAAAAAAAtt |
| SEQ ID NO: 1912 | AAAAAAAAAAAAAAAAAAtt |

TABLE 9

Candidate siRNAs for RPS26, SEQ ID NOs: 1913-2002 are based on NM_001029.

| | |
|---|---|
| SEQ ID NO: 1913 | UGGCGGAAGAAAAUCGAGGtt |
| SEQ ID NO: 1914 | AAAGUGCACAUGGGACUAUtt |
| SEQ ID NO: 1915 | AUGCGUUCCUAGUGUUUAUtt |
| SEQ ID NO: 1916 | GGAAAUGCGUUCCUAGUGUtt |
| SEQ ID NO: 1917 | AAUCUAGGGUGGAAAUGCGtt |
| SEQ ID NO: 1918 | AUUCCUUUACAUUCAGCAUtt |
| SEQ ID NO: 1919 | ACUCAAAUAUUCCUUUACAtt |
| SEQ ID NO: 1920 | ACUUUACUCAAAUAUUCCUtt |
| SEQ ID NO: 1921 | AACUCACUUUACUCAAAUAtt |
| SEQ ID NO: 1922 | UCAAGAACGGCAACUCACUtt |
| SEQ ID NO: 1923 | GAAUCCUUAGGAGACGGGCtt |
| SEQ ID NO: 1924 | GCGGACACCGGGAGAAUCCtt |
| SEQ ID NO: 1925 | CCUUCUUUUCUUUGUCAUCtt |
| SEQ ID NO: 1926 | CCAUUGUUCCUUCUUUUCUtt |
| SEQ ID NO: 1927 | ACGACCAUUGUUCCUUCUUtt |
| SEQ ID NO: 1928 | GCACGACCAUUGUUCCUUCtt |
| SEQ ID NO: 1929 | UUGGCACGACCAUUGUUCCtt |
| SEQ ID NO: 1930 | CUUUUUGGCACGACCAUUGtt |
| SEQ ID NO: 1931 | GCCCUUUUGGCACGACCAtt |
| SEQ ID NO: 1932 | CACGUGGCCGCGGCCCUUUtt |
| SEQ ID NO: 1933 | UGCACGUGGCCGCGGCCCUtt |
| SEQ ID NO: 1934 | GGGCACGCAUCGGGCACAGtt |
| SEQ ID NO: 1935 | UUUCUUAAUGGCCUUGUCCtt |

TABLE 9-continued

Candidate siRNAs for RPS26, SEQ ID NOs: 1913-2002 are based on NM_001029.

| SEQ ID NO: 1936 | GACGAAUUCUUAAUGGCCUtt |
| --- | --- |
| SEQ ID NO: 1937 | GUUUCGAAUGACGAAUUUCtt |
| SEQ ID NO: 1938 | UAUGUUUCGAAUGACGAAUtt |
| SEQ ID NO: 1939 | GCUGCGGCCUCCACUAUGUtt |
| SEQ ID NO: 1940 | AGGCAUCGAAGACGCUCGCtt |
| SEQ ID NO: 1941 | AUGUAGCUUCACAUACAGCtt |
| SEQ ID NO: 1942 | ACUCACACAGUAAUGUAGCtt |
| SEQ ID NO: 1943 | CUGACUACUUUGCUGUGAAtt |
| SEQ ID NO: 1944 | AGAUCGAUUCCUGACUACUtt |
| SEQ ID NO: 1945 | GCGGGCUUCACGAGAUCGAtt |
| SEQ ID NO: 1946 | GUGUUCGGUCCUUGCGGGCtt |
| SEQ ID NO: 1947 | GGGUGGGGGUGUUCGGUCCtt |
| SEQ ID NO: 1948 | CUAAAUCGGGGUGGGGGUGtt |
| SEQ ID NO: 1949 | UCAGCUCCUUACAUGGGCUtt |
| SEQ ID NO: 1950 | UCUUUAAGAACUCAGCUCCtt |
| SEQ ID NO: 1951 | AAUAGCCUGUCUUCAGUCUtt |
| SEQ ID NO: 1952 | CUCCAGAGAAUAGCCUGUCtt |
| SEQ ID NO: 1953 | UACAAUUUCCAUUUUAUUUtt |
| SEQ ID NO: 1954 | AGUACAAUUUCCAUUUUAUtt |
| SEQ ID NO: 1955 | UUUAAGUACAAUUUCCAUUtt |
| SEQ ID NO: 1956 | UUUUUAAGUACAAUUUCCAtt |
| SEQ ID NO: 1957 | UUUUUUUUUUAAGUACAAUtt |
| SEQ ID NO: 1958 | CCUCGAUUUUCUUCCGCCAtt |
| SEQ ID NO: 1959 | AUAGUCCCAUGUGCACUUUtt |
| SEQ ID NO: 1960 | AUAAACACUAGGAACGCAUtt |
| SEQ ID NO: 1961 | ACACUAGGAACGCAUUUCCtt |
| SEQ ID NO: 1962 | CGCAUUCCACCCUAGAUUtt |
| SEQ ID NO: 1963 | AUGCUGAAUGUAAAGGAAUtt |
| SEQ ID NO: 1964 | UGUAAAGGAAUAUUUGAGUtt |
| SEQ ID NO: 1965 | AGGAAUAUUUGAGUAAAGUtt |
| SEQ ID NO: 1966 | UAUUUGAGUAAAGUGAGUUtt |
| SEQ ID NO: 1967 | AGUGAGUUGCCGUUCUUGAtt |
| SEQ ID NO: 1968 | GCCCGUCUCCUAAGGAUUCtt |
| SEQ ID NO: 1969 | GGAUUCUCCCGGUGUCCGCtt |
| SEQ ID NO: 1970 | GAUGACAAAGAAAAGAAGGtt |
| SEQ ID NO: 1971 | AGAAAAGAAGGAACAAUGGtt |
| SEQ ID NO: 1972 | AAGAAGGAACAAUGGUCGUtt |
| SEQ ID NO: 1973 | GAAGGAACAAUGGUCGUGCtt |
| SEQ ID NO: 1974 | GGAACAAUGGUCGUGCCAAtt |
| SEQ ID NO: 1975 | CAAUGGUCGUGCCAAAAAGtt |
| SEQ ID NO: 1976 | UGGUCGUGCCAAAAAGGGCtt |
| SEQ ID NO: 1977 | AAAGGGCCGCGGCCACGUGtt |
| SEQ ID NO: 1978 | AGGGCCGCGGCCACGUGCAtt |
| SEQ ID NO: 1979 | CUGUGCCCGAUGCGUGCCCtt |
| SEQ ID NO: 1980 | GGACAAGGCCAUUAAGAAAtt |
| SEQ ID NO: 1981 | GGCCAUUAAGAAAUUCGUCtt |
| SEQ ID NO: 1982 | GAAAUUCGUCAUUCGAAACtt |
| SEQ ID NO: 1983 | AUUCGUCAUUCGAAACAUAtt |
| SEQ ID NO: 1984 | ACAUAGUGGAGGCCGCAGCtt |
| SEQ ID NO: 1985 | GCGAGCGUCUUCGAUGCCUtt |
| SEQ ID NO: 1986 | GCUGUAUGUGAAGCUACAUtt |
| SEQ ID NO: 1987 | GCUACAUUACUGUGUGAGUtt |
| SEQ ID NO: 1988 | UUCACAGCAAAGUAGUCAGtt |
| SEQ ID NO: 1989 | AGUAGUCAGGAAUCGAUCUtt |
| SEQ ID NO: 1990 | UCGAUCUCGUGAAGCCCGCtt |
| SEQ ID NO: 1991 | GCCCGCAAGGACCGAACACtt |
| SEQ ID NO: 1992 | GGACCGAACACCCCCACCCtt |
| SEQ ID NO: 1993 | CACCCCCACCCCGAUUUAGtt |
| SEQ ID NO: 1994 | AGCCCAUGUAAGGAGCUGAtt |
| SEQ ID NO: 1995 | GGAGCUGAGUUCUUAAAGAtt |
| SEQ ID NO: 1996 | AGACUGAAGACAGGCUAUUtt |
| SEQ ID NO: 1997 | GACAGGCUAUUCUCUGGAGtt |
| SEQ ID NO: 1998 | AAAUAAAAUGGAAAUUGUAtt |
| SEQ ID NO: 1999 | AUAAAAUGGAAAUUGUACUtt |
| SEQ ID NO: 2000 | AAUGGAAAUUGUACUUAAAtt |
| SEQ ID NO: 2001 | UGGAAAUUGUACUUAAAAAtt |
| SEQ ID NO: 2002 | AUUGUACUUAAAAAAAAAAtt |

TABLE 10

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| SEQ ID NO: 2003 | AGGGGCGGGGCCAGCGCCGtt |
| --- | --- |
| SEQ ID NO: 2004 | ACCAGCCCAGCUCUGCGAGtt |
| SEQ ID NO: 2005 | UGUCUUCAGCACUGCAUUtt |
| SEQ ID NO: 2006 | AGUGUCUUCAGCACUGCAAtt |
| SEQ ID NO: 2007 | CUUUUGCGGGUCCAGUGUCtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| SEQ ID NO: 2008 | GUUUGGGAGGGACAGCCUUtt |
| SEQ ID NO: 2009 | AGGUUUGGGAGGGACAGCCtt |
| SEQ ID NO: 2010 | UGAGCCCAGAAUCCCAGGUtt |
| SEQ ID NO: 2011 | CUCAAUGCCAGCAGCCUGUtt |
| SEQ ID NO: 2012 | GACUGCUAGAGGCCAGGAGtt |
| SEQ ID NO: 2013 | UUCCGGACACACUAGCACUtt |
| SEQ ID NO: 2014 | GAGACCAAGAACCCACCAAtt |
| SEQ ID NO: 2015 | AGGGUCCGCGGCUUCAUUCtt |
| SEQ ID NO: 2016 | GCGAGGGUCCGCGGCUUCAtt |
| SEQ ID NO: 2017 | GACUGCGAGGGUCCGCGGCtt |
| SEQ ID NO: 2018 | GCUCUGUGCAGCAGCAGCAtt |
| SEQ ID NO: 2019 | ACUUGAGUCUGCAGGCCUGtt |
| SEQ ID NO: 2020 | GAUCCUUGAGGGGAUUGACtt |
| SEQ ID NO: 2021 | AUGCAGAUCCUUGAGGGGAtt |
| SEQ ID NO: 2022 | CAGGCCUGAAUGCAGAUCCtt |
| SEQ ID NO: 2023 | UGGGGCUGAAAUGAAUCAUtt |
| SEQ ID NO: 2024 | CCAUCCCUGGGGUGCUGGAGtt |
| SEQ ID NO: 2025 | UCCUUAGUGUAUAUGUGUGtt |
| SEQ ID NO: 2026 | GUGGGAACUCACUUCCUCCtt |
| SEQ ID NO: 2027 | GGCUGGUGUGGGAACUCACtt |
| SEQ ID NO: 2028 | CUGGAUGUAGGUCCACAAAtt |
| SEQ ID NO: 2029 | CCAGCUGCUAGCAUCAGCUtt |
| SEQ ID NO: 2030 | CUCACGCACAUGGGACUGGtt |
| SEQ ID NO: 2031 | AGGAUUCAGCUCCCCAAUCtt |
| SEQ ID NO: 2032 | GGCUACCUUGUCUUCAGGAtt |
| SEQ ID NO: 2033 | CGGUGGGGGCUACCUUGUCtt |
| SEQ ID NO: 2034 | CUCCACGGUGGGGCUACCtt |
| SEQ ID NO: 2035 | GGGCCGCUGGCUGUUGACCtt |
| SEQ ID NO: 2036 | AUUAAAGGGCCGCUGGCUGtt |
| SEQ ID NO: 2037 | CUCAGGGGGAGGCUCUGCAtt |
| SEQ ID NO: 2038 | GGUUGGGUGUGAUGUAGUUtt |
| SEQ ID NO: 2039 | AGGGUUGGGUGUGAUGUAGtt |
| SEQ ID NO: 2040 | CCGGGUGAAGAAGAUAGGGtt |
| SEQ ID NO: 2041 | GUUAGGUACAGGCAGAUGGtt |
| SEQ ID NO: 2042 | AUAGGUGUCUGGAUCCAGGtt |
| SEQ ID NO: 2043 | GAUCUCUACCUGGGAAAGtt |
| SEQ ID NO: 2044 | AGUCAUCUCAGAGCGUCGGtt |
| SEQ ID NO: 2045 | CUCCAGACCUUUUACUUCUtt |
| SEQ ID NO: 2046 | UCCACUCCAGACCUUUUACtt |
| SEQ ID NO: 2047 | GUUCUCCACUCCAGACCUUtt |
| SEQ ID NO: 2048 | CUGUUCUCCACUCCAGACCtt |
| SEQ ID NO: 2049 | GCAGUGCUGAUGGCUCCUGtt |
| SEQ ID NO: 2050 | GGGCCUCAGUUUCACAGAGtt |
| SEQ ID NO: 2051 | AGCAGACGUGGGCCUCAGUtt |
| SEQ ID NO: 2052 | AUGCCAGCAGGACCUCAGCtt |
| SEQ ID NO: 2053 | ACGUGGCAGAGGCUGCCCAtt |
| SEQ ID NO: 2054 | ACUCACUCUGCCCAGCCAUtt |
| SEQ ID NO: 2055 | GUUGCCAGUGGCUGUAACUtt |
| SEQ ID NO: 2056 | AGCCUUUGUAAUCCCGCCGtt |
| SEQ ID NO: 2057 | CACAGAUGGAGAGAAGCCUtt |
| SEQ ID NO: 2058 | UGGCCGACUGGACAGGAAGtt |
| SEQ ID NO: 2059 | UGAUGGUCACCUCCCCUGAtt |
| SEQ ID NO: 2060 | ACCACUCCAUGCAUAGCCCtt |
| SEQ ID NO: 2061 | AGCUUAGCCACCUGCCAGGtt |
| SEQ ID NO: 2062 | CUGUUCCUCUCCAUCCAGCtt |
| SEQ ID NO: 2063 | AGGCCUUCCUGGGGCGCUGtt |
| SEQ ID NO: 2064 | CAGACGCCAUGCCCAGGCCtt |
| SEQ ID NO: 2065 | UCCAGCUGGCACAGGGGCUtt |
| SEQ ID NO: 2066 | AAACAAUGUUCAGUUCCUUtt |
| SEQ ID NO: 2067 | ACAAACAAUGUUCAGUUCCtt |
| SEQ ID NO: 2068 | CCUUACAAACAAUGUUCAGtt |
| SEQ ID NO: 2069 | CACAGCCUUACAAACAAUGtt |
| SEQ ID NO: 2070 | GUAACCAUCAUCCACAGCCtt |
| SEQ ID NO: 2071 | CACGGUGUCUGGCUGCACAtt |
| SEQ ID NO: 2072 | ACACCUCGCAGGUUCCAGAtt |
| SEQ ID NO: 2073 | GCUGAGAACACCUCGCAGGtt |
| SEQ ID NO: 2074 | AUGGACACGAUGCCAGGCAtt |
| SEQ ID NO: 2075 | AGGGGUGGAGGUGGCUCCUtt |
| SEQ ID NO: 2076 | UGAAAGGUGGGAAAGAUUUtt |
| SEQ ID NO: 2077 | GUUGAAAGGUGGGAAAGAUtt |
| SEQ ID NO: 2078 | AGAGUUGUGAUCCAAGAAGtt |
| SEQ ID NO: 2079 | UGGCUUAGGAAGGCCAGAGtt |
| SEQ ID NO: 2080 | AUGUGUACUUGGGUAUGGCtt |
| SEQ ID NO: 2081 | AAAUGUGCUAUAUGUGUACtt |
| SEQ ID NO: 2082 | GUCCAAAGAGGGAAGGUCCtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| | |
|---|---|
| SEQ ID NO: 2083 | UCACACUUCCUGGCACAGGtt |
| SEQ ID NO: 2084 | UUGCUGUAACAGCUCACACtt |
| SEQ ID NO: 2085 | UUUUUUCACUUCUAGCCCCtt |
| SEQ ID NO: 2086 | CCAGAAUUACUUUUUUCACtt |
| SEQ ID NO: 2087 | UGUCUCCAGAAUUACUUUUtt |
| SEQ ID NO: 2088 | CUUGUCUCCAGAAUUACUUtt |
| SEQ ID NO: 2089 | UGCUUGUCUCCAGAAUUACtt |
| SEQ ID NO: 2090 | AUAGUGCUUGUCUCCAGAAtt |
| SEQ ID NO: 2091 | UAGGAAGAGAAAAUAGUGCtt |
| SEQ ID NO: 2092 | GCCUUGAUGGCAGUAGGCAtt |
| SEQ ID NO: 2093 | AGAAAAGCAAAACAAGGCCtt |
| SEQ ID NO: 2094 | UUACACAUGCCACACACAUtt |
| SEQ ID NO: 2095 | GAUAGUAUAUACACUUUUCtt |
| SEQ ID NO: 2096 | UAAGAUAGUAUAUACACUUtt |
| SEQ ID NO: 2097 | UAUAAGAUAGUAUAUACACtt |
| SEQ ID NO: 2098 | AGGGAGACGGUUGUGCCCCtt |
| SEQ ID NO: 2099 | GAACUAUAAAGGGAGACGGtt |
| SEQ ID NO: 2100 | AUCUUAAACAGACUAUUUAtt |
| SEQ ID NO: 2101 | AUGAUCUUAAACAGACUAUtt |
| SEQ ID NO: 2102 | UUUUUUUUUUUUUAUGAUCtt |
| SEQ ID NO: 2103 | UUUUUUUUUUUUUUUUUUtt |
| SEQ ID NO: 2104 | CGGCGCUGGCCCCGCCCCUtt |
| SEQ ID NO: 2105 | CUCGCAGAGCUGGGCUGGUtt |
| SEQ ID NO: 2106 | AAUUGCAGUGCUGAAGACAtt |
| SEQ ID NO: 2107 | UUGCAGUGCUGAAGACACUtt |
| SEQ ID NO: 2108 | GACACUGGACCCGCAAAAGtt |
| SEQ ID NO: 2109 | AAGGCUGUCCCUCCCAAACtt |
| SEQ ID NO: 2110 | GGCUGUCCCUCCCAAACCUtt |
| SEQ ID NO: 2111 | ACCUGGGAUUCUGGGCUCAtt |
| SEQ ID NO: 2112 | ACAGGCUGCUGGCAUUGAGtt |
| SEQ ID NO: 2113 | CUCCUGGCCUCUAGCAGUCtt |
| SEQ ID NO: 2114 | AGUGCUAGUGUGUCCGAAtt |
| SEQ ID NO: 2115 | UUGGUGGGUUCUUGGUCUCtt |
| SEQ ID NO: 2116 | GAAUGAAGCCGCGGACCCUtt |
| SEQ ID NO: 2117 | UGAAGCCGCGGACCCUCGCtt |
| SEQ ID NO: 2118 | GCCGCGGACCCUCGCAGUCtt |
| SEQ ID NO: 2119 | UGCUGCUGCUGCACAGAGCtt |
| SEQ ID NO: 2120 | CAGGCCUGCAGACUCAAGUtt |
| SEQ ID NO: 2121 | GUCAAUCCCUCAAGGAUCtt |
| SEQ ID NO: 2122 | UCCCCUCAAGGAUCUGCAUtt |
| SEQ ID NO: 2123 | GGAUCUGCAUUCAGGCCUGtt |
| SEQ ID NO: 2124 | AUGAUUCAUUUCAGCCCCAtt |
| SEQ ID NO: 2125 | CUCCAGCACCCAGGGAUGGtt |
| SEQ ID NO: 2126 | CACACAUAUACACUAAGGAtt |
| SEQ ID NO: 2127 | GGAGGAAGUGAGUUCCCACtt |
| SEQ ID NO: 2128 | GUGAGUUCCCACACCAGCCtt |
| SEQ ID NO: 2129 | UUUGUGGACCUACAUCCAGtt |
| SEQ ID NO: 2130 | AGCUGAUGCUAGCAGCUGGtt |
| SEQ ID NO: 2131 | CCAGUCCCAUGUGCGUGAGtt |
| SEQ ID NO: 2132 | GAUUGGGGAGCUGAAUCCUtt |
| SEQ ID NO: 2133 | UCCUGAAGACAAGGUAGCCtt |
| SEQ ID NO: 2134 | GACAAGGUAGCCCCCACCGtt |
| SEQ ID NO: 2135 | GGUAGCCCCCACCGUGGAGtt |
| SEQ ID NO: 2136 | GGUCAACAGCCAGCGGCCCtt |
| SEQ ID NO: 2137 | CAGCCAGCGGCCCUUUAAtt |
| SEQ ID NO: 2138 | UGCAGAGCCUCCCCCUGAGtt |
| SEQ ID NO: 2139 | AACUACAUCACACCCAACCtt |
| SEQ ID NO: 2140 | CUACAUCACACCCAACCCUtt |
| SEQ ID NO: 2141 | CCCUAUCUUCUUCACCCGGtt |
| SEQ ID NO: 2142 | CCAUCUGCCUGUACCUAACtt |
| SEQ ID NO: 2143 | CCUGGAUCCAGACACCUAUtt |
| SEQ ID NO: 2144 | CUUUCCCAGGUACGAGAUCtt |
| SEQ ID NO: 2145 | CCGACGCUCUGAGAUGACUtt |
| SEQ ID NO: 2146 | AGAAGUAAAAGGUCUGGAGtt |
| SEQ ID NO: 2147 | GUAAAAGGUCUGGAGUGGAtt |
| SEQ ID NO: 2148 | AAGGUCUGGAGUGGAGAACtt |
| SEQ ID NO: 2149 | GGUCUGGAGUGGAGAACAGtt |
| SEQ ID NO: 2150 | CAGGAGCCAUCAGCACUGCtt |
| SEQ ID NO: 2151 | CUCUGUGAAACUGAGGCCCtt |
| SEQ ID NO: 2152 | ACUGAGGCCCACGUCUGCUtt |
| SEQ ID NO: 2153 | GCUGAGGUCCUGCUGGCAUtt |
| SEQ ID NO: 2154 | UGGGCAGCCUCUGCCACGUtt |
| SEQ ID NO: 2155 | AUGGCUGGGCAGAGUGAGUtt |
| SEQ ID NO: 2156 | AGUUACAGCCACUGGCAACtt |
| SEQ ID NO: 2157 | CGGCGGGAUUACAAAGGCUtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| SEQ ID NO: 2158 | AGGCUUCUCUCCAUCUGUGtt |
| SEQ ID NO: 2159 | CUUCCUGUCCAGUCGGCCAtt |
| SEQ ID NO: 2160 | UCAGGGGAGGUGACCAUCAtt |
| SEQ ID NO: 2161 | GGGCUAUGCAUGGAGUGGUtt |
| SEQ ID NO: 2162 | CCUGGCAGGUGGCUAAGCUtt |
| SEQ ID NO: 2163 | GCUGGAUGGAGAGGAACAGtt |
| SEQ ID NO: 2164 | CAGCGCCCCAGGAAGGCCUtt |
| SEQ ID NO: 2165 | GGCCUGGGCAUGGCGUCUGtt |
| SEQ ID NO: 2166 | AGCCCCUGUGCCAGCUGGAtt |
| SEQ ID NO: 2167 | AAGGAACUGAACAUUGUUUtt |
| SEQ ID NO: 2168 | GGAACUGAACAUUGUUUGUtt |
| SEQ ID NO: 2169 | CUGAACAUUGUUUGUAAGGtt |
| SEQ ID NO: 2170 | CAUUGUUUGUAAGGCUGUGtt |
| SEQ ID NO: 2171 | GGCUGUGGAUGAUGGUUACtt |
| SEQ ID NO: 2172 | UGUGCAGCCAGACACCGUGtt |
| SEQ ID NO: 2173 | UCUGGAACCUGCGAGGUGUtt |
| SEQ ID NO: 2174 | CCUGCGAGGUGUUCUCAGCtt |
| SEQ ID NO: 2175 | UGCCUGGCAUCGUGUCCAUtt |
| SEQ ID NO: 2176 | AGGAGCCACCUCCACCCCUtt |
| SEQ ID NO: 2177 | AAAUCUUUCCCACCUUUCAtt |
| SEQ ID NO: 2178 | AUCUUUCCCACCUUUCAACtt |
| SEQ ID NO: 2179 | CUUCUUGGAUCACAACUCUtt |
| SEQ ID NO: 2180 | CUCUGGCCUUCCUAAGCCAtt |
| SEQ ID NO: 2181 | GCCAUACCCAAGUACACAUtt |
| SEQ ID NO: 2182 | GUACACAUAUAGCACAUUUtt |
| SEQ ID NO: 2183 | GGACCUUCCCUCUUUGGACtt |
| SEQ ID NO: 2184 | CCUGUGCCAGGAAGUGUGAtt |
| SEQ ID NO: 2185 | GUGUGAGCUGUUACAGCAAtt |
| SEQ ID NO: 2186 | GGGGCUAGAAGUGAAAAAAtt |
| SEQ ID NO: 2187 | GUGAAAAAGUAAUUCUGGtt |
| SEQ ID NO: 2188 | AAAAGUAAUUCUGGAGACAtt |
| SEQ ID NO: 2189 | AAGUAAUUCUGGAGACAAGtt |
| SEQ ID NO: 2190 | GUAAUUCUGGAGACAAGCAtt |
| SEQ ID NO: 2191 | UUCUGGAGACAAGCACUAUtt |
| SEQ ID NO: 2192 | GCACUAUUUCUCUUCCUAtt |
| SEQ ID NO: 2193 | UGCCUACUGCCAUCAAGGCtt |
| SEQ ID NO: 2194 | GGCCUUGUUUUGCUUUUCUtt |
| SEQ ID NO: 2195 | AUGUGUGGCAUGUGUAAtt |
| SEQ ID NO: 2196 | GAAAAGUGUAUAUACUAUCtt |
| SEQ ID NO: 2197 | AAGUGUAUAUACUAUCUUAtt |
| SEQ ID NO: 2198 | GUGUAUAUACUAUCUUAUAtt |
| SEQ ID NO: 2199 | GGGGCACAACCGUCUCCCUtt |
| SEQ ID NO: 2200 | CCGUCUCCCUUUAUAGUUCtt |
| SEQ ID NO: 2201 | UAAAUAGUCUGUUUAAGAUtt |
| SEQ ID NO: 2202 | AUAGUCUGUUUAAGAUCAUtt |
| SEQ ID NO: 2203 | GAUCAUAAAAAAAAAAAAAtt |
| SEQ ID NO: 2204 | AAAAAAAAAAAAAAAAAAAtt |
| SEQ ID NO: 2205 | AGGGGCGGGGCCAGCGCCGtt |
| SEQ ID NO: 2206 | ACCAGCCCAGCUCUGCGAGtt |
| SEQ ID NO: 2207 | UGUCUUCAGCACUGCAAUUtt |
| SEQ ID NO: 2208 | AGUGUCUUCAGCACUGCAAtt |
| SEQ ID NO: 2209 | CUUUUGCGGGUCCAGUGUCtt |
| SEQ ID NO: 2210 | GUUUGGGAGGGACAGCCUUtt |
| SEQ ID NO: 2211 | AGGUUUGGGAGGGACAGCCtt |
| SEQ ID NO: 2212 | UGAGCCCAGAAUCCCAGGUtt |
| SEQ ID NO: 2213 | CUCAAUGCCAGCAGCCUGUtt |
| SEQ ID NO: 2214 | GCUCUGUGCAGCAGCAGCAtt |
| SEQ ID NO: 2215 | ACUUGAGUCUGCAGGCCUGtt |
| SEQ ID NO: 2216 | GAUCCUUGAGGGGAUUGACtt |
| SEQ ID NO: 2217 | AUGCAGAUCCUUGAGGGGAtt |
| SEQ ID NO: 2218 | CAGGCCUGAAUGCAGAUCCtt |
| SEQ ID NO: 2219 | UGGGGCUGAAAUGAAUCAUtt |
| SEQ ID NO: 2220 | CCAUCCCUGGGUGCUGGAGtt |
| SEQ ID NO: 2221 | UCCUUAGUGUAUAUGUGUGtt |
| SEQ ID NO: 2222 | GUGGGAACUCACUUCCUCCtt |
| SEQ ID NO: 2223 | GGCUGGUGUGGGAACUCACtt |
| SEQ ID NO: 2224 | CUGGAUGUAGGUCCACAAAtt |
| SEQ ID NO: 2225 | CCAGCUGCUAGCAUCAGCUtt |
| SEQ ID NO: 2226 | CUCACGCACUGGGACUGGtt |
| SEQ ID NO: 2227 | AGGAUUCAGCUCCCCAAUCtt |
| SEQ ID NO: 2228 | GGCUACCUUGUCUUCAGGAtt |
| SEQ ID NO: 2229 | CGGUGGGGCUACCUUGUCtt |
| SEQ ID NO: 2230 | CUCCACGGUGGGGCUACCtt |
| SEQ ID NO: 2231 | GGGCCGCUGGCUGUUGACCtt |
| SEQ ID NO: 2232 | AUUAAAGGGCCGCUGGCUGtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| | |
|---|---|
| SEQ ID NO: 2233 | CUCAGGGGGAGGCUCUGCAtt |
| SEQ ID NO: 2234 | GGUUGGGUGUGAUGUAGUUtt |
| SEQ ID NO: 2235 | AGGGUUGGGUGUGAUGUAGtt |
| SEQ ID NO: 2236 | CCGGGUGAAGAAGAUAGGGtt |
| SEQ ID NO: 2237 | GUUAGGUACAGGCAGAUGGtt |
| SEQ ID NO: 2238 | AUAGGUGUCUGGAUCCAGGtt |
| SEQ ID NO: 2239 | GAUCUCGUACCUGGGAAAGtt |
| SEQ ID NO: 2240 | AGUCAUCUCAGAGCGUCGGtt |
| SEQ ID NO: 2241 | CUCCAGACCUUUUACUUCUtt |
| SEQ ID NO: 2242 | UCCACUCCAGACCUUUUACtt |
| SEQ ID NO: 2243 | GUUCUCCACUCCAGACCUUtt |
| SEQ ID NO: 2244 | CUGUUCUCCACUCCAGACCtt |
| SEQ ID NO: 2245 | GCAGUGCUGAUGGCUCCUGtt |
| SEQ ID NO: 2246 | GGGCCUCAGUUUCACAGAGtt |
| SEQ ID NO: 2247 | AGCAGACGUGGGCCUCAGUtt |
| SEQ ID NO: 2248 | AUGCCAGCAGGACCUCAGCtt |
| SEQ ID NO: 2249 | ACGUGGCAGAGGCUGCCCAtt |
| SEQ ID NO: 2250 | ACUCACUCUGCCCAGCCAUtt |
| SEQ ID NO: 2251 | GUUGCCAGUGGCUGUAACUtt |
| SEQ ID NO: 2252 | AGCCUUUGUAAUCCCGCCGtt |
| SEQ ID NO: 2253 | CACAGAUGGAGAGAAGCCUtt |
| SEQ ID NO: 2254 | UGGCCGACUGGACAGGAAGtt |
| SEQ ID NO: 2255 | UGAUGGUCACCUCCCCUGAtt |
| SEQ ID NO: 2256 | ACCACUCCAUGCAUAGCCCtt |
| SEQ ID NO: 2257 | AGCUUAGCCACCUGCCAGGtt |
| SEQ ID NO: 2258 | CUGUUCCUCUCCAUCCAGCtt |
| SEQ ID NO: 2259 | AGGCCUUCCUGGGGCGCUGtt |
| SEQ ID NO: 2260 | CAGACGCCAUGCCCAGGCCtt |
| SEQ ID NO: 2261 | UCCAGCUGGCACAGGGGCUtt |
| SEQ ID NO: 2262 | AAACAAUGUUCAGUUCCUUtt |
| SEQ ID NO: 2263 | ACAAACAAUGUUCAGUUCCtt |
| SEQ ID NO: 2264 | CCUUACAAACAAUGUUCAGtt |
| SEQ ID NO: 2265 | CACAGCCUUACAAACAAUGtt |
| SEQ ID NO: 2266 | GUAACCAUCAUCCACAGCCtt |
| SEQ ID NO: 2267 | CACGGUGUCUGGCUGCACAtt |
| SEQ ID NO: 2268 | ACACCUCGCAGGUUCCAGAtt |
| SEQ ID NO: 2269 | GCUGAGAACACCUCGCAGGtt |
| SEQ ID NO: 2270 | AUGGACACGAUGCCAGGCAtt |
| SEQ ID NO: 2271 | AGGGGUGGAGGUGGCUCCUtt |
| SEQ ID NO: 2272 | UGAAAGGUGGGAAAGAUUUtt |
| SEQ ID NO: 2273 | GUUGAAAGGUGGGAAAGAUtt |
| SEQ ID NO: 2274 | AGAGUUGUGAUCCAAGAAGtt |
| SEQ ID NO: 2275 | UGGCUUAGGAAGGCCAGAGtt |
| SEQ ID NO: 2276 | AUGUGUACUUGGGUAUGGCtt |
| SEQ ID NO: 2277 | AAAUGUGCUAUAUGUGUACtt |
| SEQ ID NO: 2278 | GUCCAAAGAGGGAAGGUCCtt |
| SEQ ID NO: 2279 | UCACACUUCCUGGCACAGGtt |
| SEQ ID NO: 2280 | UUGCUGUAACAGCUCACACtt |
| SEQ ID NO: 2281 | UUUUUUCACUUCUAGCCCCtt |
| SEQ ID NO: 2282 | CCAGAAUUACUUUUUUCACtt |
| SEQ ID NO: 2283 | UGUCUCCAGAAUUACUUUUtt |
| SEQ ID NO: 2284 | CUUGUCUCCAGAAUUACUUtt |
| SEQ ID NO: 2285 | UGCUUGUCUCCAGAAUUACtt |
| SEQ ID NO: 2286 | AUAGUGCUUGUCUCCAGAAtt |
| SEQ ID NO: 2287 | UAGGAAGAGAAAAUAGUGCtt |
| SEQ ID NO: 2288 | GCCUUGAUGGCAGUAGGCAtt |
| SEQ ID NO: 2289 | AGAAAAGCAAAACAAGGCCtt |
| SEQ ID NO: 2290 | UUACACAUGCCACACACAUtt |
| SEQ ID NO: 2291 | GAUAGUAUAUACACUUUUCtt |
| SEQ ID NO: 2292 | UAAGAUAGUAUAUACACUUtt |
| SEQ ID NO: 2293 | UAUAAGAUAGUAUAUACACtt |
| SEQ ID NO: 2294 | AGGGAGACGGUUGUGCCCCtt |
| SEQ ID NO: 2295 | GAACUAUAAAGGGAGACGGtt |
| SEQ ID NO: 2296 | AUCUUAAACAGACUAUUUAtt |
| SEQ ID NO: 2297 | AUGAUCUUAAACAGACUAUtt |
| SEQ ID NO: 2298 | UUUUUUUUUUUUUAUGAUCtt |
| SEQ ID NO: 2299 | UUUUUUUUUUUUUUUUUUtt |
| SEQ ID NO: 2300 | CGGCGCUGGCCCCGCCCCUtt |
| SEQ ID NO: 2301 | CUCGCAGAGCUGGGCUGGUtt |
| SEQ ID NO: 2302 | AAUUGCAGUGCUGAAGACAtt |
| SEQ ID NO: 2303 | UUGCAGUGCUGAAGACACUtt |
| SEQ ID NO: 2304 | GACACUGGACCCGCAAAAGtt |
| SEQ ID NO: 2305 | AAGGCUGUCCCUCCCAAACtt |
| SEQ ID NO: 2306 | GGCUGUCCCUCCCAAACCUtt |
| SEQ ID NO: 2307 | ACCUGGGAUUCUGGGCUCAtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| | |
|---|---|
| SEQ ID NO: 2308 | ACAGGCUGCUGGCAUUGAGtt |
| SEQ ID NO: 2309 | UGCUGCUGCUGCACAGAGCtt |
| SEQ ID NO: 2310 | CAGGCCUGCAGACUCAAGUtt |
| SEQ ID NO: 2311 | GUCAAUCCCCUCAAGGAUCtt |
| SEQ ID NO: 2312 | UCCCCUCAAGGAUCUGCAUtt |
| SEQ ID NO: 2313 | GGAUCUGCAUUCAGGCCUGtt |
| SEQ ID NO: 2314 | AUGAUUCAUUUCAGCCCCAtt |
| SEQ ID NO: 2315 | CUCCAGCACCCAGGGAUGGtt |
| SEQ ID NO: 2316 | CACACAUAUACACUAAGGAtt |
| SEQ ID NO: 2317 | GGAGGAAGUGAGUUCCCACtt |
| SEQ ID NO: 2318 | GUGAGUUCCCACACCAGCCtt |
| SEQ ID NO: 2319 | UUUGUGGACCUACAUCCAGtt |
| SEQ ID NO: 2320 | AGCUGAUGCUAGCAGCUGGtt |
| SEQ ID NO: 2321 | CCAGUCCCAUGUGCGUGAGtt |
| SEQ ID NO: 2322 | GAUUGGGGAGCUGAAUCCUtt |
| SEQ ID NO: 2323 | UCCUGAAGACAAGGUAGCCtt |
| SEQ ID NO: 2324 | GACAAGGUAGCCCCCACCGtt |
| SEQ ID NO: 2325 | GGUAGCCCCCACCGUGGAGtt |
| SEQ ID NO: 2326 | GGUCAACAGCCAGCGGCCCtt |
| SEQ ID NO: 2327 | CAGCCAGCGGCCCUUUAAUtt |
| SEQ ID NO: 2328 | UGCAGAGCCUCCCCUGAGtt |
| SEQ ID NO: 2329 | AACUACAUCACACCCAACCtt |
| SEQ ID NO: 2330 | CUACAUCACACCCAACCCUtt |
| SEQ ID NO: 2331 | CCCUAUCUUCUUCACCCGGtt |
| SEQ ID NO: 2332 | CCAUCUGCCUGUACCUAACtt |
| SEQ ID NO: 2333 | CCUGGAUCCAGACACCUAUtt |
| SEQ ID NO: 2334 | CUUUCCCAGGUACGAGAUCtt |
| SEQ ID NO: 2335 | CCGACGCUCUGAGAUGACUtt |
| SEQ ID NO: 2336 | AGAAGUAAAGGUCUGGAGtt |
| SEQ ID NO: 2337 | GUAAAGGUCUGGAGUGGAtt |
| SEQ ID NO: 2338 | AAGGUCUGGAGUGGAGAACtt |
| SEQ ID NO: 2339 | GGUCUGGAGUGGAGAACAGtt |
| SEQ ID NO: 2340 | CAGGAGCCAUCAGCACUGCtt |
| SEQ ID NO: 2341 | CUCUGUGAAACUGAGGCCCtt |
| SEQ ID NO: 2342 | ACUGAGGCCCACGUCUGCUtt |
| SEQ ID NO: 2343 | GCUGAGGUCCUGCUGGCAUtt |
| SEQ ID NO: 2344 | UGGGCAGCCUCUGCCACGUtt |
| SEQ ID NO: 2345 | AUGGCUGGGCAGAGUGAGUtt |
| SEQ ID NO: 2346 | AGUUACAGCCACUGGCAACtt |
| SEQ ID NO: 2347 | CGGCGGGAUUACAAAGGCUtt |
| SEQ ID NO: 2348 | AGGCUUCUCUCCAUCUGUGtt |
| SEQ ID NO: 2349 | CUUCCUGUCCAGUCGGCCAtt |
| SEQ ID NO: 2350 | UCAGGGGAGGUGACCAUCAtt |
| SEQ ID NO: 2351 | GGGCUAUGCAUGGAGUGGUtt |
| SEQ ID NO: 2352 | CCUGGCAGGUGGCUAAGCUtt |
| SEQ ID NO: 2353 | GCUGGAUGGAGAGGAACAGtt |
| SEQ ID NO: 2354 | CAGCGCCCCAGGAAGGCCUtt |
| SEQ ID NO: 2355 | GGCCUGGGCAUGGCGUCUGtt |
| SEQ ID NO: 2356 | AGCCCCUGUGCCAGCUGGAtt |
| SEQ ID NO: 2357 | AAGGAACUGAACAUUGUUUtt |
| SEQ ID NO: 2358 | GGAACUGAACAUUGUUUGUtt |
| SEQ ID NO: 2359 | CUGAACAUUGUUUGUAAGGtt |
| SEQ ID NO: 2360 | CAUUGUUUGUAAGGCUGUGtt |
| SEQ ID NO: 2361 | GGCUGUGGAUGAUGGUUACtt |
| SEQ ID NO: 2362 | UGUGCAGCCAGACACCGUGtt |
| SEQ ID NO: 2363 | UCUGGAACCUGCGAGGUGUtt |
| SEQ ID NO: 2364 | CCUGCGAGGUGUUCUCAGCtt |
| SEQ ID NO: 2365 | UGCCUGGCAUCGUGUCCAUtt |
| SEQ ID NO: 2366 | AGGAGCCACCUCCACCCCUtt |
| SEQ ID NO: 2367 | AAAUCUUUCCCACCUUUCAtt |
| SEQ ID NO: 2368 | AUCUUUCCCACCUUUCAACtt |
| SEQ ID NO: 2369 | CUUCUUGGAUCACAACUCUtt |
| SEQ ID NO: 2370 | CUCUGGCCUUCCUAAGCCAtt |
| SEQ ID NO: 2371 | GCCAUACCCAAGUACACAUtt |
| SEQ ID NO: 2372 | GUACACAUAUAGCACAUUUtt |
| SEQ ID NO: 2373 | GGACCUUCCCUCUUUGGACtt |
| SEQ ID NO: 2374 | CCUGUGCCAGGAAGUGUGAtt |
| SEQ ID NO: 2375 | GUGUGAGCUGUUACAGCAAtt |
| SEQ ID NO: 2376 | GGGGCUAGAAGUGAAAAAAtt |
| SEQ ID NO: 2377 | GUGAAAAAGUAAUUCUGGtt |
| SEQ ID NO: 2378 | AAAAGUAAUUCUGGAGACAtt |
| SEQ ID NO: 2379 | AAGUAAUUCUGGAGACAAGtt |
| SEQ ID NO: 2380 | GUAAUUCUGGAGACAAGCAtt |
| SEQ ID NO: 2381 | UUCUGGAGACAAGCACUAUtt |
| SEQ ID NO: 2382 | GCACUAUUUCUCUUCCUAtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| | |
|---|---|
| SEQ ID NO: 2383 | UGCCUACUGCCAUCAAGGCtt |
| SEQ ID NO: 2384 | GGCCUUGUUUUGCUUUUCUtt |
| SEQ ID NO: 2385 | AUGUGUGUGGCAUGUGUAAtt |
| SEQ ID NO: 2386 | GAAAAGUGUAUAUACUAUCtt |
| SEQ ID NO: 2387 | AAGUGUAUAUACUAUCUUAtt |
| SEQ ID NO: 2388 | GUGUAUAUACUAUCUUAUAtt |
| SEQ ID NO: 2389 | GGGGCACAACCGUCUCCCUtt |
| SEQ ID NO: 2390 | CCGUCUCCCUUUAUAGUUCtt |
| SEQ ID NO: 2391 | UAAAUAGUCUGUUUAAGAUtt |
| SEQ ID NO: 2392 | AUAGUCUGUUUAAGAUCAUtt |
| SEQ ID NO: 2393 | GAUCAUAAAAAAAAAAAAAtt |
| SEQ ID NO: 2394 | AAAAAAAAAAAAAAAAAAAtt |
| SEQ ID NO: 2395 | AGGGGCGGGGCCAGCGCCGtt |
| SEQ ID NO: 2396 | ACCAGCCCAGCUCUGCGAGtt |
| SEQ ID NO: 2397 | UGUCUUCAGCACUGCAAUUtt |
| SEQ ID NO: 2398 | AGUGUCUUCAGCACUGCAAtt |
| SEQ ID NO: 2399 | GCAGACCGGGUCCAGUGUCtt |
| SEQ ID NO: 2400 | GCUCUGUGCAGCAGCAGCAtt |
| SEQ ID NO: 2401 | ACUUGAGUCUGCAGGCCUGtt |
| SEQ ID NO: 2402 | GAUCCUUGAGGGGAUUGACtt |
| SEQ ID NO: 2403 | AUGCAGAUCCUUGAGGGGAtt |
| SEQ ID NO: 2404 | CAGGCCUGAAUGCAGAUCCtt |
| SEQ ID NO: 2405 | UGGGGCUGAAAUGAAUCAUtt |
| SEQ ID NO: 2406 | CCAUCCCUGGGGUGCUGGAGtt |
| SEQ ID NO: 2407 | UCCUUAGUGUAUAUGUGUGtt |
| SEQ ID NO: 2408 | GUGGGAACUCACUUCCUCCtt |
| SEQ ID NO: 2409 | GGCUGGUGUGGGAACUCACtt |
| SEQ ID NO: 2410 | CUGGAUGUAGGUCCACAAAtt |
| SEQ ID NO: 2411 | CCAGCUGCUAGCAUCAGCUtt |
| SEQ ID NO: 2412 | CUCACGCACAUGGGACUGGtt |
| SEQ ID NO: 2413 | AGGAUUCAGCUCCCCAAUCtt |
| SEQ ID NO: 2414 | GGCUACCUUGUCUUCAGGAtt |
| SEQ ID NO: 2415 | CGGUGGGGGCUACCUUGUCtt |
| SEQ ID NO: 2416 | CUCCACGGUGGGGGCUACCtt |
| SEQ ID NO: 2417 | GGGCCGCUGGCUGUUGACCtt |
| SEQ ID NO: 2418 | AUUAAAGGGCCGCUGGCUGtt |
| SEQ ID NO: 2419 | CUCAGGGGGAGGCUCUGCAtt |
| SEQ ID NO: 2420 | GGUUGGGUGUGAUGUAGUUtt |
| SEQ ID NO: 2421 | AGGGUUGGGUGUGAUGUAGtt |
| SEQ ID NO: 2422 | CCGGGUGAAGAAGAUAGGGtt |
| SEQ ID NO: 2423 | GUUAGGUACAGGCAGAUGGtt |
| SEQ ID NO: 2424 | AUAGGUGUCUGGAUCCAGGtt |
| SEQ ID NO: 2425 | GAUCUCGUACCUGGGAAAGtt |
| SEQ ID NO: 2426 | AGUCAUCUCAGAGCGUCGGtt |
| SEQ ID NO: 2427 | CUCCAGACCUUUUACUUCUtt |
| SEQ ID NO: 2428 | UCCACUCCAGACCUUUUACtt |
| SEQ ID NO: 2429 | GUUCUCCACUCCAGACCUUtt |
| SEQ ID NO: 2430 | CUGUUCUCCACUCCAGACCtt |
| SEQ ID NO: 2431 | GCAGUGCUGAUGGCUCCUGtt |
| SEQ ID NO: 2432 | GGGCCUCAGUUUCACAGAGtt |
| SEQ ID NO: 2433 | AGCAGACGUGGGCCUCAGUtt |
| SEQ ID NO: 2434 | AUGCCAGCAGGACCUCAGCtt |
| SEQ ID NO: 2435 | ACGUGGCAGAGGCUGCCCAtt |
| SEQ ID NO: 2436 | ACUCACUCUGCCCAGCCAUtt |
| SEQ ID NO: 2437 | GUUGCCAGUGGCUGUAACUtt |
| SEQ ID NO: 2438 | AGCCUUUGUAAUCCCGCCGtt |
| SEQ ID NO: 2439 | CACAGAUGGAGAGAAGCCUtt |
| SEQ ID NO: 2440 | UGGCCGACUGGACAGGAAGtt |
| SEQ ID NO: 2441 | UGAUGGUCACCUCCCCUGAtt |
| SEQ ID NO: 2442 | ACCACUCCAUGCAUAGCCCtt |
| SEQ ID NO: 2443 | AGCUUAGCCACCUGCCAGGtt |
| SEQ ID NO: 2444 | CUGUUCCUCUCCAUCCAGCtt |
| SEQ ID NO: 2445 | AGGCCUUCCUGGGGCGCUGtt |
| SEQ ID NO: 2446 | CAGACGCCAUGCCCAGGCCtt |
| SEQ ID NO: 2447 | UCCAGCUGGCACAGGGGCUtt |
| SEQ ID NO: 2448 | AAACAAUGUUCAGUUCCUUtt |
| SEQ ID NO: 2449 | ACAAACAAUGUUCAGUUCCtt |
| SEQ ID NO: 2450 | CCUUACAAACAAUGUUCAGtt |
| SEQ ID NO: 2451 | CACAGCCUUACAAACAAUGtt |
| SEQ ID NO: 2452 | GUAACCAUCAUCCACAGCCtt |
| SEQ ID NO: 2453 | CACGGUGUCUGGCUGCACAtt |
| SEQ ID NO: 2454 | ACACCUCGCAGGUUCCAGAtt |
| SEQ ID NO: 2455 | GCUGAGAACACCUCGCAGGtt |
| SEQ ID NO: 2456 | AUGGACACGAUGCCAGGCAtt |
| SEQ ID NO: 2457 | AGGGGUGGAGGUGGCUCCUtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| | |
|---|---|
| SEQ ID NO: 2458 | UGAAAGGUGGGAAAGAUUUtt |
| SEQ ID NO: 2459 | GUUGAAAGGUGGGAAAGAUtt |
| SEQ ID NO: 2460 | AGAGUUGUGAUCCAAGAAGtt |
| SEQ ID NO: 2461 | UGGCUUAGGAAGGCCAGAGtt |
| SEQ ID NO: 2462 | AUGUGUACUUGGGUAUGGCtt |
| SEQ ID NO: 2463 | AAAUGUGCUAUAUGUGUACtt |
| SEQ ID NO: 2464 | GUCCAAAGAGGGAAGGUCCtt |
| SEQ ID NO: 2465 | UCACACUUCCUGGCACAGGtt |
| SEQ ID NO: 2466 | UUGCUGUAACAGCUCACACtt |
| SEQ ID NO: 2467 | UUUUUUCACUUCUAGCCCCtt |
| SEQ ID NO: 2468 | CCAGAAUUACUUUUUUCACtt |
| SEQ ID NO: 2469 | UGUCUCCAGAAUUACUUUUtt |
| SEQ ID NO: 2470 | CUUGUCUCCAGAAUUACUUtt |
| SEQ ID NO: 2471 | UGCUUGUCUCCAGAAUUACtt |
| SEQ ID NO: 2472 | AUAGUGCUUGUCUCCAGAAtt |
| SEQ ID NO: 2473 | UAGGAAGAGAAAAUAGUGCtt |
| SEQ ID NO: 2474 | GCCUUGAUGGCAGUAGGCAtt |
| SEQ ID NO: 2475 | AGAAAAGCAAAACAAGGCCtt |
| SEQ ID NO: 2476 | UUACACAUGCCACACACAUtt |
| SEQ ID NO: 2477 | GAUAGUAUAUACACUUUUCtt |
| SEQ ID NO: 2478 | UAAGAUAGUAUAUACACUUtt |
| SEQ ID NO: 2479 | UAUAAGAUAGUAUAUACACtt |
| SEQ ID NO: 2480 | AGGGAGACGGUUGUGCCCCtt |
| SEQ ID NO: 2481 | GAACUAUAAGGGAGACGGtt |
| SEQ ID NO: 2482 | AUCUUAAACAGACUAUUUAtt |
| SEQ ID NO: 2483 | AUGAUCUUAAACAGACUAUtt |
| SEQ ID NO: 2484 | UUUUUUUUUUUUUAUGAUCtt |
| SEQ ID NO: 2485 | UUUUUUUUUUUUUUUUUUtt |
| SEQ ID NO: 2486 | CGGCGCUGGCCCCGCCCCUtt |
| SEQ ID NO: 2487 | CUCGCAGAGCUGGGCUGGUtt |
| SEQ ID NO: 2488 | AAUUGCAGUGCUGAAGACAtt |
| SEQ ID NO: 2489 | UUGCAGUGCUGAAGACACUtt |
| SEQ ID NO: 2490 | GACACUGGACCCGGUCUGCtt |
| SEQ ID NO: 2491 | UGCUGCUGCUGCACAGAGCtt |
| SEQ ID NO: 2492 | CAGGCCUGCAGACUCAAGUtt |
| SEQ ID NO: 2493 | GUCAAUCCCUCAAGGAUCtt |
| SEQ ID NO: 2494 | UCCCCUCAAGGAUCUGCAUtt |
| SEQ ID NO: 2495 | GGAUCUGCAUUCAGGCCUGtt |
| SEQ ID NO: 2496 | AUGAUUCAUUUCAGCCCCAtt |
| SEQ ID NO: 2497 | CUCCAGCACCCAGGGAUGGtt |
| SEQ ID NO: 2498 | CACACAUAUACACUAAGGAtt |
| SEQ ID NO: 2499 | GGAGGAAGUGAGUUCCCACtt |
| SEQ ID NO: 2500 | GUGAGUUCCCACACCAGCCtt |
| SEQ ID NO: 2501 | UUUGUGGACCUACAUCCAGtt |
| SEQ ID NO: 2502 | AGCUGAUGCUAGCAGCUGGtt |
| SEQ ID NO: 2503 | CCAGUCCCAUGUGCGUGAGtt |
| SEQ ID NO: 2504 | GAUUGGGGAGCUGAAUCCUtt |
| SEQ ID NO: 2505 | UCCUGAAGACAAGGUAGCCtt |
| SEQ ID NO: 2506 | GACAAGGUAGCCCCCACCGtt |
| SEQ ID NO: 2507 | GGUAGCCCCCACCGUGGAGtt |
| SEQ ID NO: 2508 | GGUCAACAGCCAGCGGCCCtt |
| SEQ ID NO: 2509 | CAGCCAGCGGCCCUUUAAUtt |
| SEQ ID NO: 2510 | UGCAGAGCCUCCCCCUGAGtt |
| SEQ ID NO: 2511 | AACUACAUCACACCCAACCtt |
| SEQ ID NO: 2512 | CUACAUCACACCCAACCCUtt |
| SEQ ID NO: 2513 | CCCUAUCUUCUUCACCCGGtt |
| SEQ ID NO: 2514 | CCAUCUGCCUGUACCUAACtt |
| SEQ ID NO: 2515 | CCUGGAUCCAGACACCUAUtt |
| SEQ ID NO: 2516 | CUUUCCCAGGUACGAGAUCtt |
| SEQ ID NO: 2517 | CCGACGCUCUGAGAUGACUtt |
| SEQ ID NO: 2518 | AGAAGUAAAAGGUCUGGAGtt |
| SEQ ID NO: 2519 | GUAAAAGGUCUGGAGUGGAtt |
| SEQ ID NO: 2520 | AAGGUCUGGAGUGGAGAACtt |
| SEQ ID NO: 2521 | GGUCUGGAGUGGAGAACAGtt |
| SEQ ID NO: 2522 | CAGGAGCCAUCAGCACUGCtt |
| SEQ ID NO: 2523 | CUCUGUGAAACUGAGGCCCtt |
| SEQ ID NO: 2524 | ACUGAGGCCCACGUCUGCUtt |
| SEQ ID NO: 2525 | GCUGAGGUCCUGCUGGCAUtt |
| SEQ ID NO: 2526 | UGGGCAGCCUCUGCCACGUtt |
| SEQ ID NO: 2527 | AUGGCUGGGCAGAGUGAGUtt |
| SEQ ID NO: 2528 | AGUUACAGCCACUGGCAACtt |
| SEQ ID NO: 2529 | CGGCGGGAUUACAAAGGCUtt |
| SEQ ID NO: 2530 | AGGCUUCUCUCCAUCUGUGtt |
| SEQ ID NO: 2531 | CUUCCUGUCCAGUCGGCCAtt |
| SEQ ID NO: 2532 | UCAGGGGAGGUGACCAUCAtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| SEQ ID NO: 2533 | GGGCUAUGCAUGGAGUGGUtt |
| SEQ ID NO: 2534 | CCUGGCAGGUGGCUAAGCUtt |
| SEQ ID NO: 2535 | GCUGGAUGGAGAGGAACAGtt |
| SEQ ID NO: 2536 | CAGCGCCCCAGGAAGGCCUtt |
| SEQ ID NO: 2537 | GGCCUGGGCAUGGCGUCUGtt |
| SEQ ID NO: 2538 | AGCCCCUGUGCCAGCUGGAtt |
| SEQ ID NO: 2539 | AAGGAACUGAACAUUGUUUtt |
| SEQ ID NO: 2540 | GGAACUGAACAUUGUUUGUtt |
| SEQ ID NO: 2541 | CUGAACAUUGUUUGUAAGGtt |
| SEQ ID NO: 2542 | CAUUGUUUGUAAGGCUGUGtt |
| SEQ ID NO: 2543 | GGCUGUGGAUGAUGGUUACtt |
| SEQ ID NO: 2544 | UGUGCAGCCAGACACCGUGtt |
| SEQ ID NO: 2545 | UCUGGAACCUGCGAGGUGUtt |
| SEQ ID NO: 2546 | CCUGCGAGGUGUUCUCAGCtt |
| SEQ ID NO: 2547 | UGCCUGGCAUCGUGUCCAUtt |
| SEQ ID NO: 2548 | AGGAGCCACCUCCACCCCUtt |
| SEQ ID NO: 2549 | AAAUCUUUCCCACCUUUCAtt |
| SEQ ID NO: 2550 | AUCUUUCCCACCUUUCAACtt |
| SEQ ID NO: 2551 | CUUCUUGGAUCACAACUCUtt |
| SEQ ID NO: 2552 | CUCUGGCCUUCCUAAGCCAtt |
| SEQ ID NO: 2553 | GCCAUACCCAAGUACACAUtt |
| SEQ ID NO: 2554 | GUACACAUAUAGCACAUUUtt |
| SEQ ID NO: 2555 | GGACCUUCCCUCUUUGGACtt |
| SEQ ID NO: 2556 | CCUGUGCCAGGAAGUGUGAtt |
| SEQ ID NO: 2557 | GUGUGAGCUGUUACAGCAAtt |
| SEQ ID NO: 2558 | GGGGCUAGAAGUGAAAAAAtt |
| SEQ ID NO: 2559 | GUGAAAAAGUAAUUCUGGtt |
| SEQ ID NO: 2560 | AAAAGUAAUUCUGGAGACAtt |
| SEQ ID NO: 2561 | AAGUAAUUCUGGAGACAAGtt |
| SEQ ID NO: 2562 | GUAAUUCUGGAGACAAGCAtt |
| SEQ ID NO: 2563 | UUCUGGAGACAAGCACUAUtt |
| SEQ ID NO: 2564 | GCACUAUUUCUCUUCCUAtt |
| SEQ ID NO: 2565 | UGCCUACUGCCAUCAAGGCtt |
| SEQ ID NO: 2566 | GGCCUUGUUUUGCUUUUCUtt |
| SEQ ID NO: 2567 | AUGUGUGGCAUGUGUAAtt |
| SEQ ID NO: 2568 | GAAAAGUGUAUAUACUAUCtt |
| SEQ ID NO: 2569 | AAGUGUAUAUACUAUCUUAtt |

TABLE 10-continued

Candidate siRNAs for SUOX, SEQ ID NOs: 2003-2204 are based on NM_000456, SEQ ID NOs: 2205-2394 are based on NM_001032386, and SEQ ID NOs: 2395-2576 are based on NM_001032387.

| SEQ ID NO: 2570 | GUGUAUAUACUAUCUUAUAtt |
| SEQ ID NO: 2571 | GGGGCACAACCGUCUCCCUtt |
| SEQ ID NO: 2572 | CCGUCUCCCUUUAUAGUUCtt |
| SEQ ID NO: 2573 | UAAAUAGUCUGUUUAAGAUtt |
| SEQ ID NO: 2574 | AUAGUCUGUUUAAGAUCAUtt |
| SEQ ID NO: 2575 | GAUCAUAAAAAAAAAAAAtt |
| SEQ ID NO: 2576 | AAAAAAAAAAAAAAAAAAtt |

EXAMPLE III

The information herein above can be applied clinically to patients for diagnosing an increased susceptibility for developing T1D, and therapeutic intervention. A preferred embodiment of the invention comprises clinical application of the information described herein to a patient. Diagnostic compositions, including microarrays, and methods can be designed to identify the genetic alterations described herein in nucleic acids from a patient to assess susceptibility for developing T1D. This can occur after a patient arrives in the clinic; the patient has blood drawn, and using the diagnostic methods described herein, a clinician can detect a SNP in chromosome 12. The typical age range for a patient to be screened is between 9 and 12 years of age. The information obtained from the patient sample, which can optionally be amplified prior to assessment, will be used to diagnose a patient with an increased or decreased susceptibility for developing T1D. Kits for performing the diagnostic method of the invention are also provided herein. Such kits comprise a microarray comprising at least one of the SNPs provided herein in and the necessary reagents for assessing the patient samples as described above.

The identity of T1D-involved genes and the patient results will indicate which variants are present, and will identify those that possess an altered risk for developing T1D. The information provided herein allows for therapeutic intervention at earlier times in disease progression that previously possible. Also, as described herein above, RPS26 and other genes described on chromosome 12, provide a novel target for the development of new therapeutic agents efficacious for the treatment of T1D. In particular, it would be desirable to block expression of RPS26 in those patients that are more prone to develop the disease. In this regard, the therapeutic siRNAs described herein can be used to block expression of the gene product based on the patient signal, thereby inhibiting the pancreatic β-cell destruction that occurs in T1D.

REFERENCES

1. Cucca F, Lampis R, Congia M, et al. A correlation between the relative predisposition of MHC class II alleles to type 1 diabetes and the structure of their proteins. Human molecular genetics 2001; 10(19):2025-37.
2. Julier C, Hyer R N, Davies J, et al. Insulin-IGF2 region on chromosome 11p encodes a gene implicated in HLA-DR4-dependent diabetes susceptibility. Nature 1991; 354(6349):155-9.

3. Barratt B J, Payne F, Lowe C E, et al. Remapping the insulin gene/IDDM2 locus in type 1 diabetes. Diabetes 2004; 53(7):1884-9.
4. Bell G I, Horita S, Karam J H. A polymorphic locus near the human insulin gene is associated with insulin-dependent diabetes mellitus. Diabetes 1984; 33(2):176-83.
5. Bottini N, Musumeci L, Alonso A, et al. A functional variant of lymphoid tyrosine phosphatase is associated with type I diabetes. Nature genetics 2004; 36(4):337-8.
6. Smyth D, Cooper J D, Collins J E, et al. Replication of an association between the lymphoid tyrosine phosphatase locus (LYP/PTPN22) with type 1 diabetes, and evidence for its role as a general autoimmunity locus. Diabetes 2004; 53(11):3020-3.
7. Nistico L, Buzzetti R, Pritchard L E, et al. The CTLA-4 gene region of chromosome 2q33 is linked to, and associated with, type 1 diabetes. Belgian Diabetes Registry. Human molecular genetics 1996; 5(7):1075-80.
8. Ueda H, Howson J M, Esposito L, et al. Association of the T-cell regulatory gene CTLA4 with susceptibility to autoimmune disease. Nature 2003; 423(6939):506-11.
9. Vella A, Cooper J D, Lowe C E, et al. Localization of a type 1 diabetes locus in the IL2RA/CD25 region by use of tag single-nucleotide polymorphisms. American journal of human genetics 2005; 76(5):773-9.
10. Leiter E H, Lee C H. Mouse models and the genetics of diabetes: is there evidence for genetic overlap between type 1 and type 2 diabetes? Diabetes 2005; 54 Suppl 2:S151-8.
11. Gunderson K L, Steemers F J, Lee G, Mendoza L G, Chee M S. A genome-wide scalable SNP genotyping assay using microarray technology. Nature genetics 2005; 37(5):549-54.
12. Fisher R A. Statistical Methods for Research Workers. 1958; Hafner, New York, ed. 13.
13. de Bakker P I, McVean G, Sabeti P C, et al. A high-resolution HLA and SNP haplotype map for disease association studies in the extended human MHC. Nature genetics 2006; 38(10):1166-72.
14. Hirschhorn J N, Lohmueller K, Byrne E, Hirschhorn K. A comprehensive review of genetic association studies. Genet Med 2002; 4(2):45-61.
15. Finn R D, Mistry J, Schuster-Bockler B, et al. Pfam: clans, web tools and services. Nucleic acids research 2006; 34(Database issue):D247-51.
16. Cambi A, Figdor C G. Levels of complexity in pathogen recognition by C-type lectins. Current opinion in immunology 2005; 17(4):345-51.

While certain of the preferred embodiments of the present invention have been described and specifically exemplified above, it is not intended that the invention be limited to such embodiments. It will be apparent to one skilled in the art that various changes and modifications can be made therein without departing from the scope of the present invention, as set forth in the following claims.

SEQUENCE LISTING (2576 sequences)

SEQ ID NO: 1 - DNA, 699 bp, Homo sapiens
ggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaa

SEQ ID NO: 2 - protein, 115 aa, Homo sapiens [sequence omitted]

SEQ ID NO: 3 - DNA, 2223 bp, Homo sapiens
gcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttataaaaaaaaaaaaaaaaaacaaaaaaaaaaaaaa

SEQ ID NO: 4 - DNA, 2325 bp, Homo sapiens
gcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttataaaaaaaaaaaaaaaaaacaaaaaaaaaaaaaa

SEQ ID NO: 5 - DNA, 1050 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaatta

SEQ ID NO: 6 - DNA, 5511 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatcca

SEQ ID NO: 7 - DNA, 5506 bp, Homo sapiens
gaagctgtccgtgtcctgggccccatgacctctggggccttggcttccccagctggcagaggattgggccttccctagggccccccctttctccctcccacccgcaggcccatccatctctctctctctctcttgcacacactcttgcctctctcaggcatttgttgtgcagttcctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacaccaaaaaaaaaaaaaaaaaaaaaaaaaaaaaaaaaaaaaaaaaaaaaaaaaaaaaaa

SEQ ID NO: 8 - DNA, 699 bp, Homo sapiens; identical to SEQ ID NO: 1

SEQ ID NO: 9 - DNA, 3336 bp, Homo sapiens
ggagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaaaaaaaaaaaaaaaaaaaaaaaaaaaaaaaaaaaaaaaaa

SEQ ID NO: 10 - DNA, 2438 bp, Homo sapiens
ataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11 - DNA, 2329 bp, Homo sapiens
ataacggcgctggccccgccccttctcgagaactcgcagagctgggctggtaaaattgcagtgctgaagacactggacccggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12 - DNA, 21 bp, Artificial Sequence
  siRNA
ccagaggccccgccccugctt

SEQ ID NO: 13 - DNA, 21 bp, Artificial Sequence
  siRNA
guugccgccucccaccgagtt

SEQ ID NO: 14 - DNA, 21 bp, Artificial Sequence
  siRNA
uggccaacuugaaacaaugtt

SEQ ID NO: 15 - DNA, 21 bp, Artificial Sequence
  siRNA
ucuugucaauuuggccaactt

SEQ ID NO: 16 - DNA, 21 bp, Artificial Sequence
  siRNA
accucucgcucuugucaautt

SEQ ID NO: 17 - DNA, 21 bp, Artificial Sequence
  siRNA
cgcaguauaccucucgcuctt

SEQ ID NO: 18 - DNA, 21 bp, Artificial Sequence
  siRNA
cuuuuccaccuuuuggaagtt

SEQ ID NO: 19 - DNA, 21 bp, Artificial Sequence
  siRNA
cuccgaucuuuuccaccuutt

SEQ ID NO: 20 - DNA, 21 bp, Artificial Sequence
  siRNA
cucuccgaucuuuuccacctt

SEQ ID NO: 21 - DNA, 21 bp, Artificial Sequence
  siRNA
acgugcccucuccgaucuutt

SEQ ID NO: 22 - DNA, 21 bp, Artificial Sequence
  siRNA
guacgugcccucuccgauctt

SEQ ID NO: 23 - DNA, 21 bp, Artificial Sequence
  siRNA
cgucaacuuguuucuggcutt

SEQ ID NO: 24 - DNA, 21 bp, Artificial Sequence
  siRNA
accucucccgucaacuugutt

SEQ ID NO: 25 - DNA, 21 bp, Artificial Sequence
  siRNA
caccaccucucccgucaactt

SEQ ID NO: 26 - DNA, 21 bp, Artificial Sequence
  siRNA
aguguccaggcggauuuuctt

SEQ ID NO: 27 - DNA, 21 bp, Artificial Sequence
  siRNA
cucaguguccaggcggauutt

SEQ ID NO: 28 - DNA, 21 bp, Artificial Sequence
  siRNA
gucucaguguccaggcggatt

SEQ ID NO: 29 - DNA, 21 bp, Artificial Sequence
  siRNA
auuaggaugguuaagcucctt

SEQ ID NO: 30 - DNA, 21 bp, Artificial Sequence
  siRNA
cuugacaauauuaggauggtt

SEQ ID NO: 31 - DNA, 21 bp, Artificial Sequence
  siRNA
auccagcagcuugacaauatt

SEQ ID NO: 32 - DNA, 21 bp, Artificial Sequence
  siRNA
gugaaugacauccagcagctt

SEQ ID NO: 33 - DNA, 21 bp, Artificial Sequence
  siRNA
aaaccagguagaguuuauutt

SEQ ID NO: 34 - DNA, 21 bp, Artificial Sequence
  siRNA
aaaaaccagguagaguuuatt

SEQ ID NO: 35 - DNA, 21 bp, Artificial Sequence
  siRNA
uucaaaaaccagguagagutt

SEQ ID NO: 36 - DNA, 21 bp, Artificial Sequence
  siRNA
ugagaucuuggugcagaaatt

SEQ ID NO: 37 - DNA, 21 bp, Artificial Sequence
  siRNA
ccaugaauuucuugagauctt

SEQ ID NO: 38 - DNA, 21 bp, Artificial Sequence
  siRNA
agaggcauccaugaauuuctt

SEQ ID NO: 39 - DNA, 21 bp, Artificial Sequence
  siRNA
agcagaggcauccaugaautt

SEQ ID NO: 40 - DNA, 21 bp, Artificial Sequence
  siRNA
cagcuggaacagauagcuctt

SEQ ID NO: 41 - DNA, 21 bp, Artificial Sequence
  siRNA
aauaagcagauucugaggutt

SEQ ID NO: 42 - DNA, 21 bp, Artificial Sequence
  siRNA
cucuguguuaauaagcagatt

SEQ ID NO: 43 - DNA, 21 bp, Artificial Sequence
  siRNA
cuugauggcccccucugugtt

SEQ ID NO: 44 - DNA, 21 bp, Artificial Sequence
  siRNA
uaguccaaagucugcuagctt

SEQ ID NO: 45 - DNA, 21 bp, Artificial Sequence
  siRNA
ccacuuggggaaacuuggctt

SEQ ID NO: 46 - DNA, 21 bp, Artificial Sequence
  siRNA
cgggcccacuuggggaaactt

SEQ ID NO: 47 - DNA, 21 bp, Artificial Sequence
  siRNA
aaaaucuugccgggcccactt

SEQ ID NO: 48 - DNA, 21 bp, Artificial Sequence
  siRNA
guacaacuuuacuaaaauctt

SEQ ID NO: 49 - DNA, 21 bp, Artificial Sequence
  siRNA
auccaggggagguacaacutt

SEQ ID NO: 50 - DNA, 21 bp, Artificial Sequence
  siRNA
auaacaagcuccguccauctt

SEQ ID NO: 51 - DNA, 21 bp, Artificial Sequence
  siRNA
uagggucguagugcagcautt

SEQ ID NO: 52 - DNA, 21 bp, Artificial Sequence
  siRNA
cuuggccgaaauccgcuugtt

SEQ ID NO: 53 - DNA, 21 bp, Artificial Sequence
  siRNA
ugccuuggccgaaauccgctt

SEQ ID NO: 54 - DNA, 21 bp, Artificial Sequence
  siRNA
agggugagccagggcugcctt

SEQ ID NO: 55 - DNA, 21 bp, Artificial Sequence
  siRNA
ucgaagaugggguacuggctt

SEQ ID NO: 56 - DNA, 21 bp, Artificial Sequence
  siRNA
ugagauuagggcugggggctt

SEQ ID NO: 57 - DNA, 21 bp, Artificial Sequence
  siRNA
acuggaggagagggugagatt

SEQ ID NO: 58 - DNA, 21 bp, Artificial Sequence
  siRNA
ggugaguguuuaaggcaagtt

SEQ ID NO: 59 - DNA, 21 bp, Artificial Sequence
  siRNA
aagacuagaaggugagugutt

SEQ ID NO: 60 - DNA, 21 bp, Artificial Sequence
  siRNA
caccccuguauucccagagtt

SEQ ID NO: 61 - DNA, 21 bp, Artificial Sequence
  siRNA
ccccccuuucaccccuguatt

SEQ ID NO: 62 - DNA, 21 bp, Artificial Sequence
  siRNA
uuuucacugguuccccccutt

SEQ ID NO: 63 - DNA, 21 bp, Artificial Sequence
  siRNA
uuccuuucauuuucacuggtt

SEQ ID NO: 64 - DNA, 21 bp, Artificial Sequence
  siRNA
acugaaacuuccuuucauutt

SEQ ID NO: 65 - DNA, 21 bp, Artificial Sequence
  siRNA
auacugaaacuuccuuucatt

SEQ ID NO: 66 - DNA, 21 bp, Artificial Sequence
  siRNA
ucuaauacugaaacuuccutt

SEQ ID NO: 67 - DNA, 21 bp, Artificial Sequence
  siRNA
gugcaucuaauacugaaactt

SEQ ID NO: 68 - DNA, 21 bp, Artificial Sequence
  siRNA
aagggugguggaggcuaactt

SEQ ID NO: 69 - DNA, 21 bp, Artificial Sequence
  siRNA
uauuuuuauaccaacccuctt

SEQ ID NO: 70 - DNA, 21 bp, Artificial Sequence
  siRNA
ggcuuuuuuaaaauuauuutt

SEQ ID NO: 71 - DNA, 21 bp, Artificial Sequence
  siRNA
aaggcuuuuuuaaaauuautt

SEQ ID NO: 72 - DNA, 21 bp, Artificial Sequence
  siRNA
uaggaaggcuuuuuuaaaatt

SEQ ID NO: 73 - DNA, 21 bp, Artificial Sequence
  siRNA
aacguguaggaaggcuuuutt

SEQ ID NO: 74 - DNA, 21 bp, Artificial Sequence
  siRNA
cuaacguguaggaaggcuutt

SEQ ID NO: 75 - DNA, 21 bp, Artificial Sequence
  siRNA
aucuaacguguaggaaggctt

SEQ ID NO: 76 - DNA, 21 bp, Artificial Sequence
  siRNA
auuauggggcauucagagatt

SEQ ID NO: 77 - DNA, 21 bp, Artificial Sequence
  siRNA
aaauaauaauuauggggcatt

SEQ ID NO: 78 - DNA, 21 bp, Artificial Sequence
  siRNA
caaacacuggaaauaauaatt

SEQ ID NO: 79 - DNA, 21 bp, Artificial Sequence
  siRNA
cauuguggcagcaggaggctt

SEQ ID NO: 80 - DNA, 21 bp, Artificial Sequence
  siRNA
cauuuggccuuuauaaacatt

SEQ ID NO: 81 - DNA, 21 bp, Artificial Sequence
  siRNA
ccccgcuaucauuuggccutt

SEQ ID NO: 82 - DNA, 21 bp, Artificial Sequence
  siRNA
acuuagcccccgcuaucautt

SEQ ID NO: 83 - DNA, 21 bp, Artificial Sequence
  siRNA
gguucucaaaagcaccaactt

SEQ ID NO: 84 - DNA, 21 bp, Artificial Sequence
  siRNA
gugguuuuguuuuacuuggtt

SEQ ID NO: 85 - DNA, 21 bp, Artificial Sequence
  siRNA
cccagugguuuuguuuuactt

SEQ ID NO: 86 - DNA, 21 bp, Artificial Sequence
  siRNA
uccucccagugguuuuguutt

SEQ ID NO: 87 - DNA, 21 bp, Artificial Sequence
  siRNA
acuccucccagugguuuugtt

SEQ ID NO: 88 - DNA, 21 bp, Artificial Sequence
  siRNA
uagacuccucccagugguutt

SEQ ID NO: 89 - DNA, 21 bp, Artificial Sequence
  siRNA
aauagacuccucccaguggtt

SEQ ID NO: 90 - DNA, 21 bp, Artificial Sequence
  siRNA
auuuuuucaaccgaauucutt

SEQ ID NO: 91 - DNA, 21 bp, Artificial Sequence
  siRNA
aucuauuuuuucaaccgaatt

SEQ ID NO: 92 - DNA, 21 bp, Artificial Sequence
  siRNA
aacugauuggaucuauuuutt

SEQ ID NO: 93 - DNA, 21 bp, Artificial Sequence
  siRNA
uaaacugauuggaucuauutt

SEQ ID NO: 94 - DNA, 21 bp, Artificial Sequence
  siRNA
uauaaacugauuggaucuatt

SEQ ID NO: 95 - DNA, 21 bp, Artificial Sequence
  siRNA
uaacuaggguauaaacugatt

SEQ ID NO: 96 - DNA, 21 bp, Artificial Sequence
  siRNA
ucuucagucucccagccuatt

SEQ ID NO: 97 - DNA, 21 bp, Artificial Sequence
  siRNA
gccccacccgggcugaguctt

SEQ ID NO: 98 - DNA, 21 bp, Artificial Sequence
  siRNA
ggacuggggccaaucauuutt

SEQ ID NO: 99 - DNA, 21 bp, Artificial Sequence
  siRNA
ggggacuggggccaaucautt

SEQ ID NO: 100 - DNA, 21 bp, Artificial Sequence
  siRNA
ugucucagggccucccagatt

SEQ ID NO: 101 - DNA, 21 bp, Artificial Sequence
  siRNA
gccauggugaagcaauagatt

SEQ ID NO: 102 - DNA, 21 bp, Artificial Sequence
  siRNA
acuaaaaggaagagaaaaatt

SEQ ID NO: 103 - DNA, 21 bp, Artificial Sequence
  siRNA
aaaaugggaucagggaucctt

SEQ ID NO: 104 - DNA, 21 bp, Artificial Sequence
  siRNA
augaugccuaaacccuaactt

SEQ ID NO: 105 - DNA, 21 bp, Artificial Sequence
  siRNA
cccugaaaaagugucagcatt

SEQ ID NO: 106 - DNA, 21 bp, Artificial Sequence
  siRNA
uucuuuuaaagaaauauuutt

SEQ ID NO: 107 - DNA, 21 bp, Artificial Sequence
  siRNA
ccuucuuuuaaagaaauautt

SEQ ID NO: 108 - DNA, 21 bp, Artificial Sequence
  siRNA
auaauuguucauccuucuutt

SEQ ID NO: 109 - DNA, 21 bp, Artificial Sequence
  siRNA
auauaauuguucauccuuctt

SEQ ID NO: 110 - DNA, 21 bp, Artificial Sequence
  siRNA
uaaauauaauuguucaucctt

SEQ ID NO: 111 - DNA, 21 bp, Artificial Sequence
  siRNA
ugaaauauaaauauaauugtt

SEQ ID NO: 112 - DNA, 21 bp, Artificial Sequence
  siRNA
accugaaauauaaauauaatt

SEQ ID NO: 113 - DNA, 21 bp, Artificial Sequence
  siRNA
aaaaaagccaacucuacuatt

SEQ ID NO: 114 - DNA, 21 bp, Artificial Sequence
  siRNA
uuuuuuuuuagcacugucatt

SEQ ID NO: 115 - DNA, 21 bp, Artificial Sequence
  siRNA
aaaaaaaugcuuuuuuuuutt

SEQ ID NO: 116 - DNA, 21 bp, Artificial Sequence
  siRNA
aaaaaaaaaugcuuuuuuutt

SEQ ID NO: 117 - DNA, 21 bp, Artificial Sequence
  siRNA
uaaaaaaaaaaugcuuuuutt

SEQ ID NO: 118 - DNA, 21 bp, Artificial Sequence
  siRNA
cauaaaaaaaaaaugcuuutt

SEQ ID NO: 119 - DNA, 21 bp, Artificial Sequence
  siRNA
aucauaaaaaaaaaaugcutt

SEQ ID NO: 120 - DNA, 21 bp, Artificial Sequence
  siRNA
aacuaaauuacaaauaacgtt

SEQ ID NO: 121 - DNA, 21 bp, Artificial Sequence
  siRNA
uaaugagcuacaaacuaaatt

SEQ ID NO: 122 - DNA, 21 bp, Artificial Sequence
  siRNA
uaaaacuaggcacauuuuutt

SEQ ID NO: 123 - DNA, 21 bp, Artificial Sequence
  siRNA
uauaaaacuaggcacauuutt

SEQ ID NO: 124 - DNA, 21 bp, Artificial Sequence
  siRNA
uuuauaaaacuaggcacautt

SEQ ID NO: 125 - DNA, 21 bp, Artificial Sequence
  siRNA
uuguuuuuuuuuuuuuuuutt

SEQ ID NO: 126 - DNA, 21 bp, Artificial Sequence
  siRNA
uuuuguuuuuuuuuuuuuutt

SEQ ID NO: 127 - DNA, 21 bp, Artificial Sequence
  siRNA
uuuuuuguuuuuuuuuuuutt

SEQ ID NO: 128 - DNA, 21 bp, Artificial Sequence
  siRNA
uuuuuuuuguuuuuuuuuutt

SEQ ID NO: 129 - DNA, 21 bp, Artificial Sequence
  siRNA
uuuuuuuuuuguuuuuuuutt

SEQ ID NO: 130 - DNA, 21 bp, Artificial Sequence
  siRNA
uuuuuuuuuuuuguuuuuutt

SEQ ID NO: 131 - DNA, 21 bp, Artificial Sequence
  siRNA
uuuuuuuuuuuuuuguuuutt

SEQ ID NO: 132 - DNA, 21 bp, Artificial Sequence
  siRNA
gcaggggcggggccucuggtt

SEQ ID NO: 133 - DNA, 21 bp, Artificial Sequence
  siRNA
cucggugggaggcggcaactt

SEQ ID NO: 134 - DNA, 21 bp, Artificial Sequence
  siRNA
cauuguuucaaguuggccatt

SEQ ID NO: 135 - DNA, 21 bp, Artificial Sequence
  siRNA
guuggccaaauugacaagatt

SEQ ID NO: 136 - DNA, 21 bp, Artificial Sequence
  siRNA
auugacaagagcgagaggutt

SEQ ID NO: 137 - DNA, 21 bp, Artificial Sequence
  siRNA
gagcgagagguauacugcgtt

SEQ ID NO: 138 - DNA, 21 bp, Artificial Sequence
  siRNA
cuuccaaaagguggaaaagtt

SEQ ID NO: 139 - DNA, 21 bp, Artificial Sequence
  siRNA
aagguggaaaagaucggagtt

SEQ ID NO: 140 - DNA, 21 bp, Artificial Sequence
  siRNA
gguggaaaagaucggagagtt

SEQ ID NO: 141 - DNA, 21 bp, Artificial Sequence
  siRNA
aagaucggagagggcacgutt

SEQ ID NO: 142 - DNA, 21 bp, Artificial Sequence
  siRNA
gaucggagagggcacguactt

SEQ ID NO: 143 - DNA, 21 bp, Artificial Sequence
  siRNA
agccagaaacaaguugacgtt

SEQ ID NO: 144 - DNA, 21 bp, Artificial Sequence
  siRNA
acaaguugacgggagaggutt

SEQ ID NO: 145 - DNA, 21 bp, Artificial Sequence
  siRNA
guugacgggagagguggugtt

SEQ ID NO: 146 - DNA, 21 bp, Artificial Sequence
  siRNA
gaaaauccgccuggacacutt

SEQ ID NO: 147 - DNA, 21 bp, Artificial Sequence
  siRNA
aauccgccuggacacugagtt

SEQ ID NO: 148 - DNA, 21 bp, Artificial Sequence
  siRNA
uccgccuggacacugagactt

SEQ ID NO: 149 - DNA, 21 bp, Artificial Sequence
  siRNA
ggagcuuaaccauccuaautt

SEQ ID NO: 150 - DNA, 21 bp, Artificial Sequence
  siRNA
ccauccuaauauugucaagtt

SEQ ID NO: 151 - DNA, 21 bp, Artificial Sequence
  siRNA
uauugucaagcugcuggautt

SEQ ID NO: 152 - DNA, 21 bp, Artificial Sequence
  siRNA
gcugcuggaugucauucactt

SEQ ID NO: 153 - DNA, 21 bp, Artificial Sequence
  siRNA
aauaaacucuaccugguuutt

SEQ ID NO: 154 - DNA, 21 bp, Artificial Sequence
  siRNA
uaaacucuaccugguuuuutt

SEQ ID NO: 155 - DNA, 21 bp, Artificial Sequence
  siRNA
acucuaccugguuuuugaatt

SEQ ID NO: 156 - DNA, 21 bp, Artificial Sequence
  siRNA
uuucugcaccaagaucucatt

SEQ ID NO: 157 - DNA, 21 bp, Artificial Sequence
  siRNA
gaucucaagaaauucauggtt

SEQ ID NO: 158 - DNA, 21 bp, Artificial Sequence
  siRNA
gaaauucauggaugccucutt

SEQ ID NO: 159 - DNA, 21 bp, Artificial Sequence
  siRNA
auucauggaugccucugcutt

SEQ ID NO: 160 - DNA, 21 bp, Artificial Sequence
  siRNA
gagcuaucuguuccagcugtt

SEQ ID NO: 161 - DNA, 21 bp, Artificial Sequence
  siRNA
accucagaaucugcuuauutt

SEQ ID NO: 162 - DNA, 21 bp, Artificial Sequence
  siRNA
ucugcuuauuaacacagagtt

SEQ ID NO: 163 - DNA, 21 bp, Artificial Sequence
  siRNA
cacagagggggccaucaagtt

SEQ ID NO: 164 - DNA, 21 bp, Artificial Sequence
  siRNA
gcuagcagacuuuggacuatt

SEQ ID NO: 165 - DNA, 21 bp, Artificial Sequence
  siRNA
gccaaguuuccccaaguggtt

SEQ ID NO: 166 - DNA, 21 bp, Artificial Sequence
  siRNA
guuuccccaagugggcccgtt

SEQ ID NO: 167 - DNA, 21 bp, Artificial Sequence
  siRNA
gugggcccggcaagauuuutt

SEQ ID NO: 168 - DNA, 21 bp, Artificial Sequence
  siRNA
gauuuuaguaaaguuguactt

SEQ ID NO: 169 - DNA, 21 bp, Artificial Sequence
  siRNA
aguuguaccuccccuggautt

SEQ ID NO: 170 - DNA, 21 bp, Artificial Sequence
  siRNA
gauggacggagcuuguuautt

SEQ ID NO: 171 - DNA, 21 bp, Artificial Sequence
  siRNA
augcugcacuacgacccuatt

SEQ ID NO: 172 - DNA, 21 bp, Artificial Sequence
  siRNA
caagcggauuucggccaagtt

SEQ ID NO: 173 - DNA, 21 bp, Artificial Sequence
  siRNA
gcggauuucggccaaggcatt

SEQ ID NO: 174 - DNA, 21 bp, Artificial Sequence
  siRNA
ggcagcccuggcucacccutt

SEQ ID NO: 175 - DNA, 21 bp, Artificial Sequence
  siRNA
gccaguaccccaucuucgatt

SEQ ID NO: 176 - DNA, 21 bp, Artificial Sequence
  siRNA
gcccccagcccuaaucucatt

SEQ ID NO: 177 - DNA, 21 bp, Artificial Sequence
  siRNA
ucucacccucuccuccagutt

SEQ ID NO: 178 - DNA, 21 bp, Artificial Sequence
  siRNA
cuugccuuaaacacucacctt

SEQ ID NO: 179 - DNA, 21 bp, Artificial Sequence
  siRNA
acacucaccuucuagucuutt

SEQ ID NO: 180 - DNA, 21 bp, Artificial Sequence
  siRNA
cucugggaauacaggggugtt

SEQ ID NO: 181 - DNA, 21 bp, Artificial Sequence
  siRNA
uacaggggugaaaggggggtt

SEQ ID NO: 182 - DNA, 21 bp, Artificial Sequence
  siRNA
aggggggaaccagugaaaatt

SEQ ID NO: 183 - DNA, 21 bp, Artificial Sequence
  siRNA
ccagugaaaaugaaaggaatt

SEQ ID NO: 184 - DNA, 21 bp, Artificial Sequence
  siRNA
aaugaaaggaaguuucagutt

SEQ ID NO: 185 - DNA, 21 bp, Artificial Sequence
  siRNA
ugaaaggaaguuucaguautt

SEQ ID NO: 186 - DNA, 21 bp, Artificial Sequence
  siRNA
aggaaguuucaguauuagatt

SEQ ID NO: 187 - DNA, 21 bp, Artificial Sequence
  siRNA
guuucaguauuagaugcactt

SEQ ID NO: 188 - DNA, 21 bp, Artificial Sequence
  siRNA
guuagccuccaccacccuutt

SEQ ID NO: 189 - DNA, 21 bp, Artificial Sequence
  siRNA
gaggguugguauaaaaauatt

SEQ ID NO: 190 - DNA, 21 bp, Artificial Sequence
  siRNA
aaauaauuuuaaaaaagcctt

SEQ ID NO: 191 - DNA, 21 bp, Artificial Sequence
  siRNA
auaauuuuaaaaaagccuutt

SEQ ID NO: 192 - DNA, 21 bp, Artificial Sequence
  siRNA
uuuuaaaaaagccuuccuatt

SEQ ID NO: 193 - DNA, 21 bp, Artificial Sequence
  siRNA
aaaagccuuccuacacguutt

SEQ ID NO: 194 - DNA, 21 bp, Artificial Sequence
  siRNA
aagccuuccuacacguuagtt

SEQ ID NO: 195 - DNA, 21 bp, Artificial Sequence
  siRNA
gccuuccuacacguuagautt

SEQ ID NO: 196 - DNA, 21 bp, Artificial Sequence
  siRNA
ucucugaaugccccauaautt

SEQ ID NO: 197 - DNA, 21 bp, Artificial Sequence
  siRNA
ugccccauaauuauuauuutt

SEQ ID NO: 198 - DNA, 21 bp, Artificial Sequence
  siRNA
uuauuauuuccaguguuugtt

SEQ ID NO: 199 - DNA, 21 bp, Artificial Sequence
  siRNA
gccuccugcugccacaaugtt

SEQ ID NO: 200 - DNA, 21 bp, Artificial Sequence
  siRNA
uguuuauaaaggccaaaugtt

SEQ ID NO: 201 - DNA, 21 bp, Artificial Sequence
  siRNA
aggccaaaugauagcggggtt

SEQ ID NO: 202 - DNA, 21 bp, Artificial Sequence
  siRNA
augauagcgggggcuaagutt

SEQ ID NO: 203 - DNA, 21 bp, Artificial Sequence
  siRNA
guuggugcuuuugagaacctt

SEQ ID NO: 204 - DNA, 21 bp, Artificial Sequence
  siRNA
ccaaguaaaacaaaaccactt

SEQ ID NO: 205 - DNA, 21 bp, Artificial Sequence
  siRNA
guaaaacaaaaccacugggtt

SEQ ID NO: 206 - DNA, 21 bp, Artificial Sequence
  siRNA
aacaaaaccacugggaggatt

SEQ ID NO: 207 - DNA, 21 bp, Artificial Sequence
  siRNA
caaaaccacugggaggagutt

SEQ ID NO: 208 - DNA, 21 bp, Artificial Sequence
  siRNA
aaccacugggaggagucuatt

SEQ ID NO: 209 - DNA, 21 bp, Artificial Sequence
  siRNA
ccacugggaggagucuauutt

SEQ ID NO: 210 - DNA, 21 bp, Artificial Sequence
  siRNA
agaauucgguugaaaaaautt

SEQ ID NO: 211 - DNA, 21 bp, Artificial Sequence
  siRNA
uucgguugaaaaaauagautt

SEQ ID NO: 212 - DNA, 21 bp, Artificial Sequence
  siRNA
aaaauagauccaaucaguutt

SEQ ID NO: 213 - DNA, 21 bp, Artificial Sequence
  siRNA
aauagauccaaucaguuuatt

SEQ ID NO: 214 - DNA, 21 bp, Artificial Sequence
  siRNA
uagauccaaucaguuuauatt

SEQ ID NO: 215 - DNA, 21 bp, Artificial Sequence
  siRNA
ucaguuuauacccuaguuatt

SEQ ID NO: 216 - DNA, 21 bp, Artificial Sequence
  siRNA
uaggcugggagacugaagatt

SEQ ID NO: 217 - DNA, 21 bp, Artificial Sequence
  siRNA
gacucagcccggguggggctt

SEQ ID NO: 218 - DNA, 21 bp, Artificial Sequence
  siRNA
aaaugauuggccccagucctt

SEQ ID NO: 219 - DNA, 21 bp, Artificial Sequence
  siRNA
augauuggccccagucccctt

SEQ ID NO: 220 - DNA, 21 bp, Artificial Sequence
  siRNA
ucugggaggcccugagacatt

SEQ ID NO: 221 - DNA, 21 bp, Artificial Sequence
  siRNA
ucuauugcuucaccauggctt

SEQ ID NO: 222 - DNA, 21 bp, Artificial Sequence
  siRNA
uuuuucucuuccuuuuagutt

SEQ ID NO: 223 - DNA, 21 bp, Artificial Sequence
  siRNA
ggaucccugaucccauuuutt

SEQ ID NO: 224 - DNA, 21 bp, Artificial Sequence
  siRNA
guuaggguuuaggcaucautt

SEQ ID NO: 225 - DNA, 21 bp, Artificial Sequence
  siRNA
ugcugacacuuuuucagggtt

SEQ ID NO: 226 - DNA, 21 bp, Artificial Sequence
  siRNA
aaauauuucuuuaaaagaatt

SEQ ID NO: 227 - DNA, 21 bp, Artificial Sequence
  siRNA
auauuucuuuaaaagaaggtt

SEQ ID NO: 228 - DNA, 21 bp, Artificial Sequence
  siRNA
aagaaggaugaacaauuautt

SEQ ID NO: 229 - DNA, 21 bp, Artificial Sequence
  siRNA
gaaggaugaacaauuauautt

SEQ ID NO: 230 - DNA, 21 bp, Artificial Sequence
  siRNA
ggaugaacaauuauauuuatt

SEQ ID NO: 231 - DNA, 21 bp, Artificial Sequence
  siRNA
caauuauauuuauauuucatt

SEQ ID NO: 232 - DNA, 21 bp, Artificial Sequence
  siRNA
uuauauuuauauuucaggutt

SEQ ID NO: 233 - DNA, 21 bp, Artificial Sequence
  siRNA
uaguagaguuggcuuuuuutt

SEQ ID NO: 234 - DNA, 21 bp, Artificial Sequence
  siRNA
ugacagugcuaaaaaaaaatt

SEQ ID NO: 235 - DNA, 21 bp, Artificial Sequence
  siRNA
aaaaaaaaagcauuuuuuutt

SEQ ID NO: 236 - DNA, 21 bp, Artificial Sequence
  siRNA
aaaaaaagcauuuuuuuuutt

SEQ ID NO: 237 - DNA, 21 bp, Artificial Sequence
  siRNA
aaaaagcauuuuuuuuuuatt

SEQ ID NO: 238 - DNA, 21 bp, Artificial Sequence
  siRNA
aaagcauuuuuuuuuuaugtt

SEQ ID NO: 239 - DNA, 21 bp, Artificial Sequence
  siRNA
agcauuuuuuuuuuaugautt

SEQ ID NO: 240 - DNA, 21 bp, Artificial Sequence
  siRNA
cguuauuuguaauuuaguutt

SEQ ID NO: 241 - DNA, 21 bp, Artificial Sequence
  siRNA
uuuaguuuguagcucauuatt

SEQ ID NO: 242 - DNA, 21 bp, Artificial Sequence
  siRNA
aaaaaugugccuaguuuuatt

SEQ ID NO: 243 - DNA, 21 bp, Artificial Sequence
  siRNA
aaaugugccuaguuuuauatt

SEQ ID NO: 244 - DNA, 21 bp, Artificial Sequence
  siRNA
augugccuaguuuuauaaatt

SEQ ID NO: 245 - DNA, 21 bp, Artificial Sequence
  siRNA
aaaaaaaaaaaaaaaacaatt

SEQ ID NO: 246 - DNA, 21 bp, Artificial Sequence
  siRNA
aaaaaaaaaaaaaacaaaatt

SEQ ID NO: 247 - DNA, 21 bp, Artificial Sequence
  siRNA
aaaaaaaaaaaacaaaaaatt

SEQ ID NO: 248 - DNA, 21 bp, Artificial Sequence
  siRNA
aaaaaaaaaacaaaaaaaatt

SEQ ID NO: 249 - DNA, 21 bp, Artificial Sequence
  siRNA
aaaaaaaacaaaaaaaaaatt

SEQ ID NO: 250 - DNA, 21 bp, Artificial Sequence
  siRNA
aaaaaacaaaaaaaaaaaatt

SEQ ID NO: 251 - DNA, 21 bp, Artificial Sequence
  siRNA
aaaacaaaaaaaaaaaaaatt

SEQ ID NO: 252 - DNA, 21 bp, Artificial Sequence
  siRNA
ccagaggccccgccccugctt

SEQ ID NO: 253 - DNA, 21 bp, Artificial Sequence
  siRNA
guugccgccucccaccgagtt

SEQ ID NO: 254 - DNA, 21 bp, Artificial Sequence
  siRNA
uggccaacuugaaacaaugtt

SEQ ID NO: 255 - DNA, 21 bp, Artificial Sequence
  siRNA
ucuugucaauuuggccaactt

SEQ ID NO: 256 - DNA, 21 bp, Artificial Sequence
  siRNA
accucucgcucuugucaautt

SEQ ID NO: 257 - DNA, 21 bp, Artificial Sequence
  siRNA
cgcaguauaccucucgcuctt

SEQ ID NO: 258 - DNA, 21 bp, Artificial Sequence
  siRNA
cuuuuccaccuuuuggaagtt

SEQ ID NO: 259 - DNA, 21 bp, Artificial Sequence
  siRNA
cuccgaucuuuuccaccuutt

SEQ ID NO: 260 - DNA, 21 bp, Artificial Sequence
  siRNA
cucuccgaucuuuuccacctt

SEQ ID NO: 261 - DNA, 21 bp, Artificial Sequence
  siRNA
acgugcccucuccgaucuutt

SEQ ID NO: 262 - DNA, 21 bp, Artificial Sequence
  siRNA
guacgugcccucuccgauctt

SEQ ID NO: 263 - DNA, 21 bp, Artificial Sequence
  siRNA
cgucaacuuguuucuggcutt

SEQ ID NO: 264 - DNA, 21 bp, Artificial Sequence
  siRNA
accucucccgucaacuugutt

SEQ ID NO: 265 - DNA, 21 bp, Artificial Sequence
  siRNA
caccaccucucccgucaactt

SEQ ID NO: 266 - DNA, 21 bp, Artificial Sequence
  siRNA
aguguccaggcggauuuuctt

SEQ ID NO: 267 - DNA, 21 bp, Artificial Sequence
  siRNA
cucaguguccaggcggauutt

SEQ ID NO: 268 - DNA, 21 bp, Artificial Sequence
  siRNA
gucucaguguccaggcggatt

SEQ ID NO: 269 - DNA, 21 bp, Artificial Sequence
  siRNA
auuaggaugguuaagcucctt

SEQ ID NO: 270 - DNA, 21 bp, Artificial Sequence
  siRNA
cuugacaauauuaggauggtt

SEQ ID NO: 271 - DNA, 21 bp, Artificial Sequence
  siRNA
auccagcagcuugacaauatt

SEQ ID NO: 272 - DNA, 21 bp, Artificial Sequence
  siRNA
gugaaugacauccagcagctt

SEQ ID NO: 273 - DNA, 21 bp, Artificial Sequence
  siRNA
aaaccagguagaguuuauutt

SEQ ID NO: 274 - DNA, 21 bp, Artificial Sequence
  siRNA
aaaaaccagguagaguuuatt

SEQ ID NO: 275 - DNA, 21 bp, Artificial Sequence
  siRNA
uucaaaaaccagguagagutt

SEQ ID NO: 276 - DNA, 21 bp, Artificial Sequence
  siRNA
ugagaucuuggugcagaaatt

SEQ ID NO: 277 - DNA, 21 bp, Artificial Sequence
  siRNA
ccaugaauuucuugagauctt

SEQ ID NO: 278 - DNA, 21 bp, Artificial Sequence
  siRNA
agaggcauccaugaauuuctt

SEQ ID NO: 279 - DNA, 21 bp, Artificial Sequence
  siRNA
agcagaggcauccaugaautt

SEQ ID NO: 280 - DNA, 21 bp, Artificial Sequence
  siRNA
cagcuggaacagauagcuctt

SEQ ID NO: 281 - DNA, 21 bp, Artificial Sequence
  siRNA
aauaagcagauucugaggutt

SEQ ID NO: 282 - DNA, 21 bp, Artificial Sequence
  siRNA
cucuguguuaauaagcagatt

SEQ ID NO: 283 - DNA, 21 bp, Artificial Sequence
  siRNA
cuugauggcccccucugugtt

SEQ ID NO: 284 - DNA, 21 bp, Artificial Sequence
  siRNA
uaguccaaagucugcuagctt

SEQ ID NO: 285 - DNA, 21 bp, Artificial Sequence
  siRNA
auuugcagcccaggaggautt

SEQ ID NO: 286 - DNA, 21 bp, Artificial Sequence
  siRNA
cacagcuguggaauaauautt

SEQ ID NO: 287 - DNA, 21 bp, Artificial Sequence
  siRNA
ccacuuggggaaacuuggctt

SEQ ID NO: 288 - DNA, 21 bp, Artificial Sequence
  siRNA
cgggcccacuuggggaaactt

SEQ ID NO: 289 - DNA, 21 bp, Artificial Sequence
  siRNA
aaaaucuugccgggcccactt

SEQ ID NO: 290 - DNA, 21 bp, Artificial Sequence
  siRNA
guacaacuuuacuaaaauctt

SEQ ID NO: 291 - DNA, 21 bp, Artificial Sequence
  siRNA
auccaggggagguacaacutt

SEQ ID NO: 292 - DNA, 21 bp, Artificial Sequence
  siRNA
auaacaagcuccguccauctt

SEQ ID NO: 293 - DNA, 21 bp, Artificial Sequence
  siRNA
uagggucguagugcagcautt

SEQ ID NO: 294 - DNA, 21 bp, Artificial Sequence
  siRNA
cuuggccgaaauccgcuugtt

SEQ ID NO: 295 - DNA, 21 bp, Artificial Sequence
  siRNA
ugccuuggccgaaauccgctt

SEQ ID NO: 296 - DNA, 21 bp, Artificial Sequence
  siRNA
agggugagccagggcugcctt

SEQ ID NO: 297 - DNA, 21 bp, Artificial Sequence
  siRNA
ucgaagaugggguacuggctt

SEQ ID NO: 298 - DNA, 21 bp, Artificial Sequence
  siRNA
ugagauuagggcugggggctt

SEQ ID NO: 299 - DNA, 21 bp, Artificial Sequence
  siRNA
acuggaggagagggugagatt

SEQ ID NO: 300 - DNA, 21 bp, Artificial Sequence
  siRNA
ggugaguguuuaaggcaagtt

SEQ ID NO: 301 - DNA, 21 bp, Artificial Sequence
  siRNA
aagacuagaaggugagugutt

SEQ ID NO: 302 - DNA, 21 bp, Artificial Sequence
  siRNA
caccccuguauucccagagtt

SEQ ID NO: 303 - DNA, 21 bp, Artificial Sequence
  siRNA
ccccccuuucaccccuguatt

SEQ ID NO: 304 - DNA, 21 bp, Artificial Sequence
  siRNA
uuuucacugguuccccccutt

SEQ ID NO: 305 - DNA, 21 bp, Artificial Sequence
  siRNA
uuccuuucauuuucacuggtt

SEQ ID NO: 306 - DNA, 21 bp, Artificial Sequence
  siRNA
acugaaacuuccuuucauutt

SEQ ID NO: 307 - DNA, 21 bp, Artificial Sequence
  siRNA
auacugaaacuuccuuucatt

SEQ ID NO: 308 - DNA, 21 bp, Artificial Sequence
  siRNA
ucuaauacugaaacuuccutt

SEQ ID NO: 309 - DNA, 21 bp, Artificial Sequence
  siRNA
gugcaucuaauacugaaactt

SEQ ID NO: 310 - DNA, 21 bp, Artificial Sequence
  siRNA
aagggugguggaggcuaactt

SEQ ID NO: 311 - DNA, 21 bp, Artificial Sequence
  siRNA
uauuuuuauaccaacccuctt

SEQ ID NO: 312 - DNA, 21 bp, Artificial Sequence
  siRNA
ggcuuuuuuaaaauuauuutt

SEQ ID NO: 313 - DNA, 21 bp, Artificial Sequence
  siRNA
aaggcuuuuuuaaaauuautt

SEQ ID NO: 314 - DNA, 21 bp, Artificial Sequence
  siRNA
uaggaaggcuuuuuuaaaatt

SEQ ID NO: 315 - DNA, 21 bp, Artificial Sequence
  siRNA
aacguguaggaaggcuuuutt

SEQ ID NO: 316 - DNA, 21 bp, Artificial Sequence
  siRNA
cuaacguguaggaaggcuutt

SEQ ID NO: 317 - DNA, 21 bp, Artificial Sequence
  siRNA
aucuaacguguaggaaggctt

SEQ ID NO: 318 - DNA, 21 bp, Artificial Sequence
  siRNA
auuauggggcauucagagatt

SEQ ID NO: 319 - DNA, 21 bp, Artificial Sequence
  siRNA
aaauaauaauuauggggcatt

SEQ ID NO: 320 - DNA, 21 bp, Artificial Sequence
  siRNA
caaacacuggaaauaauaatt

SEQ ID NO: 321 - DNA, 21 bp, Artificial Sequence
  siRNA
cauuguggcagcaggaggctt

SEQ ID NO: 322 - DNA, 21 bp, Artificial Sequence
  siRNA
cauuuggccuuuauaaacatt

SEQ ID NO: 323 - DNA, 21 bp, Artificial Sequence
  siRNA
ccccgcuaucauuuggccutt

SEQ ID NO: 324 - DNA, 21 bp, Artificial Sequence
  siRNA
acuuagcccccgcuaucautt

SEQ ID NO: 325 - DNA, 21 bp, Artificial Sequence
  siRNA
gguucucaaaagcaccaactt

SEQ ID NO: 326 - DNA, 21 bp, Artificial Sequence
  siRNA
gugguuuuguuuuacuuggtt

SEQ ID NO: 327 - DNA, 21 bp, Artificial Sequence
  siRNA
cccagugguuuuguuuuactt

SEQ ID NO: 328 - DNA, 21 bp, Artificial Sequence
  siRNA
uccucccagugguuuuguutt

SEQ ID NO: 329 - DNA, 21 bp, Artificial Sequence
  siRNA
acuccucccagugguuuugtt

SEQ ID NO: 330 - DNA, 21 bp, Artificial Sequence
  siRNA
uagacuccucccagugguutt

SEQ ID NO: 331 - DNA, 21 bp, Artificial Sequence
  siRNA
aauagacuccucccaguggtt

SEQ ID NO: 332 - DNA, 21 bp, Artificial Sequence
  siRNA
auuuuuucaaccgaauucutt

SEQ ID NO: 333 - DNA, 21 bp, Artificial Sequence
  siRNA
aucuauuuuuucaaccgaatt

SEQ ID NO: 334 - DNA, 21 bp, Artificial Sequence
  siRNA
aacugauuggaucuauuuutt

SEQ ID NO: 335 - DNA, 21 bp, Artificial Sequence
  siRNA
uaaacugauuggaucuauutt

SEQ ID NO: 336 - DNA, 21 bp, Artificial Sequence
  siRNA
uauaaacugauuggaucuatt

SEQ ID NO: 337 - DNA, 21 bp, Artificial Sequence
  siRNA
uaacuaggguauaaacugatt

SEQ ID NO: 338 - DNA, 21 bp, Artificial Sequence
  siRNA
ucuucagucucccagccuatt

SEQ ID NO: 339 - DNA, 21 bp, Artificial Sequence
  siRNA
gccccacccgggcugaguctt

SEQ ID NO: 340 - DNA, 21 bp, Artificial Sequence
  siRNA
ggacuggggccaaucauuutt

SEQ ID NO: 341 - DNA, 21 bp, Artificial Sequence
  siRNA
ggggacuggggccaaucautt

SEQ ID NO: 342 - DNA, 21 bp, Artificial Sequence
  siRNA
ugucucagggccucccagatt

SEQ ID NO: 343 - DNA, 21 bp, Artificial Sequence
  siRNA
gccauggugaagcaauagatt

SEQ ID NO: 344 - DNA, 21 bp, Artificial Sequence
  siRNA
acuaaaaggaagagaaaaatt

SEQ ID NO: 345 - DNA, 21 bp, Artificial Sequence
  siRNA
aaaaugggaucagggaucctt

SEQ ID NO: 346 - DNA, 21 bp, Artificial Sequence
  siRNA
augaugccuaaacccuaactt

SEQ ID NO: 347 - DNA, 21 bp, Artificial Sequence
  siRNA
cccugaaaaagugucagcatt

SEQ ID NO: 348 - DNA, 21 bp, Artificial Sequence
  siRNA
uucuuuuaaagaaauauuutt

SEQ ID NO: 349 - DNA, 21 bp, Artificial Sequence
  siRNA
ccuucuuuuaaagaaauautt

SEQ ID NO: 350 - DNA, 21 bp, Artificial Sequence
  siRNA
auaauuguucauccuucuutt

SEQ ID NO: 351 - DNA, 21 bp, Artificial Sequence
  siRNA
auauaauuguucauccuuctt

SEQ ID NO: 352 - DNA, 21 bp, Artificial Sequence
  siRNA
uaaauauaauuguucaucctt

SEQ ID NO: 353 - DNA, 21 bp, Artificial Sequence
  siRNA
ugaaauauaaauauaauugtt

SEQ ID NO: 354 - DNA, 21 bp, Artificial Sequence
  siRNA
accugaaauauaaauauaatt

SEQ ID NO: 355 - DNA, 21 bp, Artificial Sequence
  siRNA
aaaaaagccaacucuacuatt

SEQ ID NO: 356 - DNA, 21 bp, Artificial Sequence
  siRNA
uuuuuuuuuagcacugucatt

SEQ ID NO: 357 - DNA, 21 bp, Artificial Sequence
  siRNA
aaaaaaaugcuuuuuuuuutt

SEQ ID NO: 358 - DNA, 21 bp, Artificial Sequence
  siRNA
aaaaaaaaaugcuuuuuuutt

SEQ ID NO: 359 - DNA, 21 bp, Artificial Sequence
  siRNA
uaaaaaaaaaaugcuuuuutt

SEQ ID NO: 360 - DNA, 21 bp, Artificial Sequence
  siRNA
cauaaaaaaaaaaugcuuutt

SEQ ID NO: 361 - DNA, 21 bp, Artificial Sequence
  siRNA
aucauaaaaaaaaaaugcutt

SEQ ID NO: 362 - DNA, 21 bp, Artificial Sequence
  siRNA
aacuaaauuacaaauaacgtt

SEQ ID NO: 363 - DNA, 21 bp, Artificial Sequence
  siRNA
uaaugagcuacaaacuaaatt

SEQ ID NO: 364 - DNA, 21 bp, Artificial Sequence
  siRNA
uaaaacuaggcacauuuuutt

SEQ ID NO: 365 - DNA, 21 bp, Artificial Sequence
  siRNA
uauaaaacuaggcacauuutt

SEQ ID NO: 366 - DNA, 21 bp, Artificial Sequence
  siRNA
uuuauaaaacuaggcacautt

SEQ ID NO: 367 - DNA, 21 bp, Artificial Sequence
  siRNA
uuguuuuuuuuuuuuuuuutt

SEQ ID NO: 368 - DNA, 21 bp, Artificial Sequence
  siRNA
uuuuguuuuuuuuuuuuuutt

SEQ ID NO: 369 - DNA, 21 bp, Artificial Sequence
  siRNA
uuuuuuguuuuuuuuuuuutt

SEQ ID NO: 370 - DNA, 21 bp, Artificial Sequence
  siRNA
uuuuuuuuguuuuuuuuuutt

SEQ ID NO: 371 - DNA, 21 bp, Artificial Sequence
  siRNA
uuuuuuuuuuguuuuuuuutt

SEQ ID NO: 372 - DNA, 21 bp, Artificial Sequence
  siRNA
uuuuuuuuuuuuguuuuuutt

SEQ ID NO: 373 - DNA, 21 bp, Artificial Sequence
  siRNA
uuuuuuuuuuuuuuguuuutt

SEQ ID NO: 374 - DNA, 21 bp, Artificial Sequence
  siRNA
gcaggggcggggccucuggtt

SEQ ID NO: 375 - DNA, 21 bp, Artificial Sequence
  siRNA
cucggugggaggcggcaactt

SEQ ID NO: 376 - DNA, 21 bp, Artificial Sequence
  siRNA
cauuguuucaaguuggccatt

SEQ ID NO: 377 - DNA, 21 bp, Artificial Sequence
  siRNA
guuggccaaauugacaagatt

SEQ ID NO: 378 - DNA, 21 bp, Artificial Sequence
  siRNA
auugacaagagcgagaggutt

SEQ ID NO: 379 - DNA, 21 bp, Artificial Sequence
  siRNA
gagcgagagguauacugcgtt

SEQ ID NO: 380 - DNA, 21 bp, Artificial Sequence
  siRNA
cuuccaaaagguggaaaagtt

SEQ ID NO: 381 - DNA, 21 bp, Artificial Sequence
  siRNA
aagguggaaaagaucggagtt

SEQ ID NO: 382 - DNA, 21 bp, Artificial Sequence
  siRNA
gguggaaaagaucggagagtt

SEQ ID NO: 383 - DNA, 21 bp, Artificial Sequence
  siRNA
aagaucggagagggcacgutt

SEQ ID NO: 384 - DNA, 21 bp, Artificial Sequence
  siRNA
gaucggagagggcacguactt

SEQ ID NO: 385 - DNA, 21 bp, Artificial Sequence
  siRNA
agccagaaacaaguugacgtt

SEQ ID NO: 386 - DNA, 21 bp, Artificial Sequence
  siRNA
acaaguugacgggagaggutt

SEQ ID NO: 387 - DNA, 21 bp, Artificial Sequence
  siRNA
guugacgggagagguggugtt

SEQ ID NO: 388 - DNA, 21 bp, Artificial Sequence
  siRNA
gaaaauccgccuggacacutt

SEQ ID NO: 389 - DNA, 21 bp, Artificial Sequence
  siRNA
aauccgccuggacacugagtt

SEQ ID NO: 390 - DNA, 21 bp, Artificial Sequence
  siRNA
uccgccuggacacugagactt

SEQ ID NO: 391 - DNA, 21 bp, Artificial Sequence
  siRNA
ggagcuuaaccauccuaautt

SEQ ID NO: 392 - DNA, 21 bp, Artificial Sequence
  siRNA
ccauccuaauauugucaagtt

SEQ ID NO: 393 - DNA, 21 bp, Artificial Sequence
  siRNA
uauugucaagcugcuggautt

SEQ ID NO: 394 - DNA, 21 bp, Artificial Sequence
  siRNA
gcugcuggaugucauucactt

SEQ ID NO: 395 - DNA, 21 bp, Artificial Sequence
  siRNA
aauaaacucuaccugguuutt

SEQ ID NO: 396 - DNA, 21 bp, Artificial Sequence
  siRNA
uaaacucuaccugguuuuutt

SEQ ID NO: 397 - DNA, 21 bp, Artificial Sequence
  siRNA
acucuaccugguuuuugaatt

SEQ ID NO: 398 - DNA, 21 bp, Artificial Sequence
  siRNA
uuucugcaccaagaucucatt

SEQ ID NO: 399 - DNA, 21 bp, Artificial Sequence
  siRNA
gaucucaagaaauucauggtt

SEQ ID NO: 400 - DNA, 21 bp, Artificial Sequence
  siRNA
gaaauucauggaugccucutt

SEQ ID NO: 401 - DNA, 21 bp, Artificial Sequence
  siRNA
auucauggaugccucugcutt

SEQ ID NO: 402 - DNA, 21 bp, Artificial Sequence
  siRNA
gagcuaucuguuccagcugtt

SEQ ID NO: 403 - DNA, 21 bp, Artificial Sequence
  siRNA
accucagaaucugcuuauutt

SEQ ID NO: 404 - DNA, 21 bp, Artificial Sequence
  siRNA
ucugcuuauuaacacagagtt

SEQ ID NO: 405 - DNA, 21 bp, Artificial Sequence
  siRNA
cacagagggggccaucaagtt

SEQ ID NO: 406 - DNA, 21 bp, Artificial Sequence
  siRNA
gcuagcagacuuuggacuatt

SEQ ID NO: 407 - DNA, 21 bp, Artificial Sequence
  siRNA
auccuccugggcugcaaautt

SEQ ID NO: 408 - DNA, 21 bp, Artificial Sequence
  siRNA
auauuauuccacagcugugtt

SEQ ID NO: 409 - DNA, 21 bp, Artificial Sequence
  siRNA
gccaaguuuccccaaguggtt

SEQ ID NO: 410 - DNA, 21 bp, Artificial Sequence
  siRNA
guuuccccaagugggcccgtt

SEQ ID NO: 411 - DNA, 21 bp, Artificial Sequence
  siRNA
gugggcccggcaagauuuutt

SEQ ID NO: 412 - DNA, 21 bp, Artificial Sequence
  siRNA
gauuuuaguaaaguuguactt

SEQ ID NO: 413 - DNA, 21 bp, Artificial Sequence
  siRNA
aguuguaccuccccuggautt

SEQ ID NO: 414 - DNA, 21 bp, Artificial Sequence
  siRNA
gauggacggagcuuguuautt

SEQ ID NO: 415 - DNA, 21 bp, Artificial Sequence
  siRNA
augcugcacuacgacccuatt

SEQ ID NO: 416 - DNA, 21 bp, Artificial Sequence
  siRNA
caagcggauuucggccaagtt

SEQ ID NO: 417 - DNA, 21 bp, Artificial Sequence
  siRNA
gcggauuucggccaaggcatt

SEQ ID NO: 418 - DNA, 21 bp, Artificial Sequence
  siRNA
ggcagcccuggcucacccutt

SEQ ID NO: 419 - DNA, 21 bp, Artificial Sequence
  siRNA
gccaguaccccaucuucgatt

SEQ ID NO: 420 - DNA, 21 bp, Artificial Sequence
  siRNA
gcccccagcccuaaucucatt

SEQ ID NO: 421 - DNA, 21 bp, Artificial Sequence
  siRNA
ucucacccucuccuccagutt

SEQ ID NO: 422 - DNA, 21 bp, Artificial Sequence
  siRNA
cuugccuuaaacacucacctt

SEQ ID NO: 423 - DNA, 21 bp, Artificial Sequence
  siRNA
acacucaccuucuagucuutt

SEQ ID NO: 424 - DNA, 21 bp, Artificial Sequence
  siRNA
cucugggaauacaggggugtt

SEQ ID NO: 425 - DNA, 21 bp, Artificial Sequence
  siRNA
uacaggggugaaaggggggtt

SEQ ID NO: 426 - DNA, 21 bp, Artificial Sequence
  siRNA
aggggggaaccagugaaaatt

SEQ ID NO: 427 - DNA, 21 bp, Artificial Sequence
  siRNA
ccagugaaaaugaaaggaatt

SEQ ID NO: 428 - DNA, 21 bp, Artificial Sequence
  siRNA
aaugaaaggaaguuucagutt

SEQ ID NO: 429 - DNA, 21 bp, Artificial Sequence
  siRNA
ugaaaggaaguuucaguautt

SEQ ID NO: 430 - DNA, 21 bp, Artificial Sequence
  siRNA
aggaaguuucaguauuagatt

SEQ ID NO: 431 - DNA, 21 bp, Artificial Sequence
  siRNA
guuucaguauuagaugcactt

SEQ ID NO: 432 - DNA, 21 bp, Artificial Sequence
  siRNA
guuagccuccaccacccuutt

SEQ ID NO: 433 - DNA, 21 bp, Artificial Sequence
  siRNA
gaggguugguauaaaaauatt

SEQ ID NO: 434 - DNA, 21 bp, Artificial Sequence
  siRNA
aaauaauuuuaaaaaagcctt

SEQ ID NO: 435 - DNA, 21 bp, Artificial Sequence
  siRNA
auaauuuuaaaaaagccuutt

SEQ ID NO: 436 - DNA, 21 bp, Artificial Sequence
  siRNA
uuuuaaaaaagccuuccuatt

SEQ ID NO: 437 - DNA, 21 bp, Artificial Sequence
  siRNA
aaaagccuuccuacacguutt

SEQ ID NO: 438 - DNA, 21 bp, Artificial Sequence
  siRNA
aagccuuccuacacguuagtt

SEQ ID NO: 439 - DNA, 21 bp, Artificial Sequence
  siRNA
gccuuccuacacguuagautt

SEQ ID NO: 440 - DNA, 21 bp, Artificial Sequence
  siRNA
ucucugaaugccccauaautt

SEQ ID NO: 441 - DNA, 21 bp, Artificial Sequence
  siRNA
ugccccauaauuauuauuutt

SEQ ID NO: 442 - DNA, 21 bp, Artificial Sequence
  siRNA
uuauuauuuccaguguuugtt

SEQ ID NO: 443 - DNA, 21 bp, Artificial Sequence
  siRNA
gccuccugcugccacaaugtt

SEQ ID NO: 444 - DNA, 21 bp, Artificial Sequence
  siRNA
uguuuauaaaggccaaaugtt

SEQ ID NO: 445 - DNA, 21 bp, Artificial Sequence
  siRNA
aggccaaaugauagcggggtt

SEQ ID NO: 446 - DNA, 21 bp, Artificial Sequence
  siRNA
augauagcgggggcuaagutt

SEQ ID NO: 447 - DNA, 21 bp, Artificial Sequence
  siRNA
guuggugcuuuugagaacctt

SEQ ID NO: 448 - DNA, 21 bp, Artificial Sequence
  siRNA
ccaaguaaaacaaaaccactt

SEQ ID NO: 449 - DNA, 21 bp, Artificial Sequence
  siRNA
guaaaacaaaaccacugggtt

SEQ ID NO: 450 - DNA, 21 bp, Artificial Sequence
  siRNA
aacaaaaccacugggaggatt

SEQ ID NO: 451 - DNA, 21 bp, Artificial Sequence
  siRNA
caaaaccacugggaggagutt

SEQ ID NO: 452 - DNA, 21 bp, Artificial Sequence
  siRNA
aaccacugggaggagucuatt

SEQ ID NO: 453 - DNA, 21 bp, Artificial Sequence
  siRNA
ccacugggaggagucuauutt

SEQ ID NO: 454 - DNA, 21 bp, Artificial Sequence
  siRNA
agaauucgguugaaaaaautt

SEQ ID NO: 455 - DNA, 21 bp, Artificial Sequence
  siRNA
uucgguugaaaaaauagautt

SEQ ID NO: 456 - DNA, 21 bp, Artificial Sequence
  siRNA
aaaauagauccaaucaguutt

SEQ ID NO: 457 - DNA, 21 bp, Artificial Sequence
  siRNA
aauagauccaaucaguuuatt

SEQ ID NO: 458 - DNA, 21 bp, Artificial Sequence
  siRNA
uagauccaaucaguuuauatt

SEQ ID NO: 459 - DNA, 21 bp, Artificial Sequence
  siRNA
ucaguuuauacccuaguuatt

SEQ ID NO: 460 - DNA, 21 bp, Artificial Sequence
  siRNA
uaggcugggagacugaagatt

SEQ ID NO: 461 - DNA, 21 bp, Artificial Sequence
  siRNA
gacucagcccggguggggctt

SEQ ID NO: 462 - DNA, 21 bp, Artificial Sequence
  siRNA
aaaugauuggccccagucctt

SEQ ID NO: 463 - DNA, 21 bp, Artificial Sequence
  siRNA
augauuggccccagucccctt

SEQ ID NO: 464 - DNA, 21 bp, Artificial Sequence
  siRNA
ucugggaggcccugagacatt

SEQ ID NO: 465 - DNA, 21 bp, Artificial Sequence
  siRNA
ucuauugcuucaccauggctt

SEQ ID NO: 466 - DNA, 21 bp, Artificial Sequence
  siRNA
uuuuucucuuccuuuuagutt

SEQ ID NO: 467 - DNA, 21 bp, Artificial Sequence
  siRNA
ggaucccugaucccauuuutt

SEQ ID NO: 468 - DNA, 21 bp, Artificial Sequence
  siRNA
guuaggguuuaggcaucautt

SEQ ID NO: 469 - DNA, 21 bp, Artificial Sequence
  siRNA
ugcugacacuuuuucagggtt

SEQ ID NO: 470 - DNA, 21 bp, Artificial Sequence
  siRNA
aaauauuucuuuaaaagaatt

SEQ ID NO: 471 - DNA, 21 bp, Artificial Sequence
  siRNA
auauuucuuuaaaagaaggtt

SEQ ID NO: 472 - DNA, 21 bp, Artificial Sequence
  siRNA
aagaaggaugaacaauuautt

SEQ ID NO: 473 - DNA, 21 bp, Artificial Sequence
  siRNA
gaaggaugaacaauuauautt

SEQ ID NO: 474 - DNA, 21 bp, Artificial Sequence
  siRNA
ggaugaacaauuauauuuatt

SEQ ID NO: 475 - DNA, 21 bp, Artificial Sequence
  siRNA
caauuauauuuauauuucatt

SEQ ID NO: 476 - DNA, 21 bp, Artificial Sequence
  siRNA
uuauauuuauauuucaggutt

SEQ ID NO: 477 - DNA, 21 bp, Artificial Sequence
  siRNA
uaguagaguuggcuuuuuutt

SEQ ID NO: 478 - DNA, 21 bp, Artificial Sequence
  siRNA
ugacagugcuaaaaaaaaatt

SEQ ID NO: 479 - DNA, 21 bp, Artificial Sequence
  siRNA
aaaaaaaaagcauuuuuuutt

SEQ ID NO: 480 - DNA, 21 bp, Artificial Sequence
  siRNA
aaaaaaagcauuuuuuuuutt

SEQ ID NO: 481 - DNA, 21 bp, Artificial Sequence
  siRNA
aaaaagcauuuuuuuuuuatt

SEQ ID NO: 482 - DNA, 21 bp, Artificial Sequence
  siRNA
aaagcauuuuuuuuuuaugtt

SEQ ID NO: 483 - DNA, 21 bp, Artificial Sequence
  siRNA
agcauuuuuuuuuuaugautt

SEQ ID NO: 484 - DNA, 21 bp, Artificial Sequence
  siRNA
cguuauuuguaauuuaguutt

SEQ ID NO: 485 - DNA, 21 bp, Artificial Sequence
  siRNA
uuuaguuuguagcucauuatt

SEQ ID NO: 486 - DNA, 21 bp, Artificial Sequence
  siRNA
aaaaaugugccuaguuuuatt

SEQ ID NO: 487 - DNA, 21 bp, Artificial Sequence
  siRNA
aaaugugccuaguuuuauatt

SEQ ID NO: 488 - DNA, 21 bp, Artificial Sequence
  siRNA
augugccuaguuuuauaaatt

SEQ ID NO: 489 - DNA, 21 bp, Artificial Sequence
  siRNA
cggcagcggagguugcaaatt

SEQ ID NO: 490 - DNA, 21 bp, Artificial Sequence
  siRNA
gcggcgacggcagcggaggtt

SEQ ID NO: 491 - DNA, 21 bp, Artificial Sequence
  siRNA
caccugaaccgcuggcgaatt

SEQ ID NO: 492 - DNA, 21 bp, Artificial Sequence
  siRNA
cagcaccugcagagcgucgtt

SEQ ID NO: 493 - DNA, 21 bp, Artificial Sequence
  siRNA
aggacacacugccugagagtt

SEQ ID NO: 494 - DNA, 21 bp, Artificial Sequence
  siRNA
gccggucacacucaggccatt

SEQ ID NO: 495 - DNA, 21 bp, Artificial Sequence
  siRNA
guacagugucugguauuggtt

SEQ ID NO: 496 - DNA, 21 bp, Artificial Sequence
  siRNA
gcuuguacagugucugguatt

SEQ ID NO: 497 - DNA, 21 bp, Artificial Sequence
  siRNA
cucacaccucucguagagctt

SEQ ID NO: 498 - DNA, 21 bp, Artificial Sequence
  siRNA
cgugagcacaaucucaaggtt

SEQ ID NO: 499 - DNA, 21 bp, Artificial Sequence
  siRNA
caggaaggagaggucggcatt

SEQ ID NO: 500 - DNA, 21 bp, Artificial Sequence
  siRNA
cgaggacauagccugucactt

SEQ ID NO: 501 - DNA, 21 bp, Artificial Sequence
  siRNA
ugguagaguagagaauucatt

SEQ ID NO: 502 - DNA, 21 bp, Artificial Sequence
  siRNA
gcaaugguagaguagagaatt

SEQ ID NO: 503 - DNA, 21 bp, Artificial Sequence
  siRNA
cccucgcaccacgcggaggtt

SEQ ID NO: 504 - DNA, 21 bp, Artificial Sequence
  siRNA
caugacgaagauggcaaactt

SEQ ID NO: 505 - DNA, 21 bp, Artificial Sequence
  siRNA
gcuggaguugguguuauagtt

SEQ ID NO: 506 - DNA, 21 bp, Artificial Sequence
  siRNA
agcguggcuggaguuggugtt

SEQ ID NO: 507 - DNA, 21 bp, Artificial Sequence
  siRNA
gcgcagagcguggcuggagtt

SEQ ID NO: 508 - DNA, 21 bp, Artificial Sequence
  siRNA
caucaaggagguaccaguctt

SEQ ID NO: 509 - DNA, 21 bp, Artificial Sequence
  siRNA
gcacuuagagugagcaguctt

SEQ ID NO: 510 - DNA, 21 bp, Artificial Sequence
  siRNA
ggcaccuuggaagaggcactt

SEQ ID NO: 511 - DNA, 21 bp, Artificial Sequence
  siRNA
ggccaaggugacaggcacctt

SEQ ID NO: 512 - DNA, 21 bp, Artificial Sequence
  siRNA
cuuagggagcaauggaccutt

SEQ ID NO: 513 - DNA, 21 bp, Artificial Sequence
  siRNA
acugggggcccucuauugctt

SEQ ID NO: 514 - DNA, 21 bp, Artificial Sequence
  siRNA
cccuacugggggcccucuatt

SEQ ID NO: 515 - DNA, 21 bp, Artificial Sequence
  siRNA
acaaggacacaggguuccutt

SEQ ID NO: 516 - DNA, 21 bp, Artificial Sequence
  siRNA
gccccacaaggacacagggtt

SEQ ID NO: 517 - DNA, 21 bp, Artificial Sequence
  siRNA
uuugaaauuagaaaaacggtt

SEQ ID NO: 518 - DNA, 21 bp, Artificial Sequence
  siRNA
gguacacuguacuuugaaatt

SEQ ID NO: 519 - DNA, 21 bp, Artificial Sequence
  siRNA
gccuccgguacacuguacutt

SEQ ID NO: 520 - DNA, 21 bp, Artificial Sequence
  siRNA
gccucccaaaaugcugggatt

SEQ ID NO: 521 - DNA, 21 bp, Artificial Sequence
  siRNA
cucaagugaucugcccucctt

SEQ ID NO: 522 - DNA, 21 bp, Artificial Sequence
  siRNA
gagacaggguuucgccaugtt

SEQ ID NO: 523 - DNA, 21 bp, Artificial Sequence
  siRNA
uuuuuaguagagacagggutt

SEQ ID NO: 524 - DNA, 21 bp, Artificial Sequence
  siRNA
auuuuauuuuuuuguauuutt

SEQ ID NO: 525 - DNA, 21 bp, Artificial Sequence
  siRNA
uuauuuuauuuuuuuguautt

SEQ ID NO: 526 - DNA, 21 bp, Artificial Sequence
  siRNA
uuuauuuuauuuuauuuuutt

SEQ ID NO: 527 - DNA, 21 bp, Artificial Sequence
  siRNA
uuuuuauuuuauuuuauuutt

SEQ ID NO: 528 - DNA, 21 bp, Artificial Sequence
  siRNA
auuuuuuauuuuauuuuautt

SEQ ID NO: 529 - DNA, 21 bp, Artificial Sequence
  siRNA
uuugcaaccuccgcugccgtt

SEQ ID NO: 530 - DNA, 21 bp, Artificial Sequence
  siRNA
ccuccgcugccgucgccgctt

SEQ ID NO: 531 - DNA, 21 bp, Artificial Sequence
  siRNA
uucgccagcgguucaggugtt

SEQ ID NO: 532 - DNA, 21 bp, Artificial Sequence
  siRNA
cgacgcucugcaggugcugtt

SEQ ID NO: 533 - DNA, 21 bp, Artificial Sequence
  siRNA
cucucaggcaguguguccutt

SEQ ID NO: 534 - DNA, 21 bp, Artificial Sequence
  siRNA
uggccugagugugaccggctt

SEQ ID NO: 535 - DNA, 21 bp, Artificial Sequence
  siRNA
ccaauaccagacacuguactt

SEQ ID NO: 536 - DNA, 21 bp, Artificial Sequence
  siRNA
uaccagacacuguacaagctt

SEQ ID NO: 537 - DNA, 21 bp, Artificial Sequence
  siRNA
gcucuacgagaggugugagtt

SEQ ID NO: 538 - DNA, 21 bp, Artificial Sequence
  siRNA
ccuugagauugugcucacgtt

SEQ ID NO: 539 - DNA, 21 bp, Artificial Sequence
  siRNA
ugccgaccucuccuuccugtt

SEQ ID NO: 540 - DNA, 21 bp, Artificial Sequence
  siRNA
gugacaggcuauguccucgtt

SEQ ID NO: 541 - DNA, 21 bp, Artificial Sequence
  siRNA
ugaauucucuacucuaccatt

SEQ ID NO: 542 - DNA, 21 bp, Artificial Sequence
  siRNA
uucucuacucuaccauugctt

SEQ ID NO: 543 - DNA, 21 bp, Artificial Sequence
  siRNA
ccuccgcguggugcgagggtt

SEQ ID NO: 544 - DNA, 21 bp, Artificial Sequence
  siRNA
guuugccaucuucgucaugtt

SEQ ID NO: 545 - DNA, 21 bp, Artificial Sequence
  siRNA
cuauaacaccaacuccagctt

SEQ ID NO: 546 - DNA, 21 bp, Artificial Sequence
  siRNA
caccaacuccagccacgcutt

SEQ ID NO: 547 - DNA, 21 bp, Artificial Sequence
  siRNA
cuccagccacgcucugcgctt

SEQ ID NO: 548 - DNA, 21 bp, Artificial Sequence
  siRNA
gacugguaccuccuugaugtt

SEQ ID NO: 549 - DNA, 21 bp, Artificial Sequence
  siRNA
gacugcucacucuaagugctt

SEQ ID NO: 550 - DNA, 21 bp, Artificial Sequence
  siRNA
gugccucuuccaaggugcctt

SEQ ID NO: 551 - DNA, 21 bp, Artificial Sequence
  siRNA
ggugccugucaccuuggcctt

SEQ ID NO: 552 - DNA, 21 bp, Artificial Sequence
  siRNA
agguccauugcucccuaagtt

SEQ ID NO: 553 - DNA, 21 bp, Artificial Sequence
  siRNA
gcaauagagggcccccagutt

SEQ ID NO: 554 - DNA, 21 bp, Artificial Sequence
  siRNA
uagagggcccccaguagggtt

SEQ ID NO: 555 - DNA, 21 bp, Artificial Sequence
  siRNA
aggaacccuguguccuugutt

SEQ ID NO: 556 - DNA, 21 bp, Artificial Sequence
  siRNA
cccuguguccuuguggggctt

SEQ ID NO: 557 - DNA, 21 bp, Artificial Sequence
  siRNA
ccguuuuucuaauuucaaatt

SEQ ID NO: 558 - DNA, 21 bp, Artificial Sequence
  siRNA
uuucaaaguacaguguacctt

SEQ ID NO: 559 - DNA, 21 bp, Artificial Sequence
  siRNA
aguacaguguaccggaggctt

SEQ ID NO: 560 - DNA, 21 bp, Artificial Sequence
  siRNA
ucccagcauuuugggaggctt

SEQ ID NO: 561 - DNA, 21 bp, Artificial Sequence
  siRNA
ggagggcagaucacuugagtt

SEQ ID NO: 562 - DNA, 21 bp, Artificial Sequence
  siRNA
cauggcgaaacccugucuctt

SEQ ID NO: 563 - DNA, 21 bp, Artificial Sequence
  siRNA
acccugucucuacuaaaaatt

SEQ ID NO: 564 - DNA, 21 bp, Artificial Sequence
  siRNA
aaauacaaaaaaauaaaautt

SEQ ID NO: 565 - DNA, 21 bp, Artificial Sequence
  siRNA
auacaaaaaaauaaaauaatt

SEQ ID NO: 566 - DNA, 21 bp, Artificial Sequence
  siRNA
aaaaauaaaauaaaauaaatt

SEQ ID NO: 567 - DNA, 21 bp, Artificial Sequence
  siRNA
aaauaaaauaaaauaaaaatt

SEQ ID NO: 568 - DNA, 21 bp, Artificial Sequence
  siRNA
auaaaauaaaauaaaaaautt

SEQ ID NO: 569 - DNA, 21 bp, Artificial Sequence
  siRNA
cggcagcggagguugcaaatt

SEQ ID NO: 570 - DNA, 21 bp, Artificial Sequence
  siRNA
gcggcgacggcagcggaggtt

SEQ ID NO: 571 - DNA, 21 bp, Artificial Sequence
  siRNA
caccugaaccgcuggcgaatt

SEQ ID NO: 572 - DNA, 21 bp, Artificial Sequence
  siRNA
cagcaccugcagagcgucgtt

SEQ ID NO: 573 - DNA, 21 bp, Artificial Sequence
  siRNA
aggacacacugccugagagtt

SEQ ID NO: 574 - DNA, 21 bp, Artificial Sequence
  siRNA
gccggucacacucaggccatt

SEQ ID NO: 575 - DNA, 21 bp, Artificial Sequence
  siRNA
guacagugucugguauuggtt

SEQ ID NO: 576 - DNA, 21 bp, Artificial Sequence
  siRNA
gcuuguacagugucugguatt

SEQ ID NO: 577 - DNA, 21 bp, Artificial Sequence
  siRNA
cucacaccucucguagagctt

SEQ ID NO: 578 - DNA, 21 bp, Artificial Sequence
  siRNA
cgugagcacaaucucaaggtt

SEQ ID NO: 579 - DNA, 21 bp, Artificial Sequence
  siRNA
caggaaggagaggucggcatt

SEQ ID NO: 580 - DNA, 21 bp, Artificial Sequence
  siRNA
cgaggacauagccugucactt

SEQ ID NO: 581 - DNA, 21 bp, Artificial Sequence
  siRNA
ugguagaguagagaauucatt

SEQ ID NO: 582 - DNA, 21 bp, Artificial Sequence
  siRNA
gcaaugguagaguagagaatt

SEQ ID NO: 583 - DNA, 21 bp, Artificial Sequence
  siRNA
cccucgcaccacgcggaggtt

SEQ ID NO: 584 - DNA, 21 bp, Artificial Sequence
  siRNA
caugacgaagauggcaaactt

SEQ ID NO: 585 - DNA, 21 bp, Artificial Sequence
  siRNA
gcuggaguugguguuauagtt

SEQ ID NO: 586 - DNA, 21 bp, Artificial Sequence
  siRNA
agcguggcuggaguuggugtt

SEQ ID NO: 587 - DNA, 21 bp, Artificial Sequence
  siRNA
gcgcagagcguggcuggagtt

SEQ ID NO: 588 - DNA, 21 bp, Artificial Sequence
  siRNA
gugacaaagcuuaucguuctt

SEQ ID NO: 589 - DNA, 21 bp, Artificial Sequence
  siRNA
caugugacaaagcuuaucgtt

SEQ ID NO: 590 - DNA, 21 bp, Artificial Sequence
  siRNA
uguguccaugugacaaagctt

SEQ ID NO: 591 - DNA, 21 bp, Artificial Sequence
  siRNA
acgaugucccuccagucaatt

SEQ ID NO: 592 - DNA, 21 bp, Artificial Sequence
  siRNA
acagcuucugccauugucctt

SEQ ID NO: 593 - DNA, 21 bp, Artificial Sequence
  siRNA
ggggggacagcuucugccatt

SEQ ID NO: 594 - DNA, 21 bp, Artificial Sequence
  siRNA
ucaugacaggggggacagctt

SEQ ID NO: 595 - DNA, 21 bp, Artificial Sequence
  siRNA
aggaccccagcaucgcccctt

SEQ ID NO: 596 - DNA, 21 bp, Artificial Sequence
  siRNA
uggucaaugucuggcaguctt

SEQ ID NO: 597 - DNA, 21 bp, Artificial Sequence
  siRNA
cugaggagcacagaugguctt

SEQ ID NO: 598 - DNA, 21 bp, Artificial Sequence
  siRNA
gggcccaaagcagugaccatt

SEQ ID NO: 599 - DNA, 21 bp, Artificial Sequence
  siRNA
auggcagcacugguuggggtt

SEQ ID NO: 600 - DNA, 21 bp, Artificial Sequence
  siRNA
cucaucauggcagcacuggtt

SEQ ID NO: 601 - DNA, 21 bp, Artificial Sequence
  siRNA
uacacaggcuccacugucatt

SEQ ID NO: 602 - DNA, 21 bp, Artificial Sequence
  siRNA
cagcuggaaaguuagcuugtt

SEQ ID NO: 603 - DNA, 21 bp, Artificial Sequence
  siRNA
uuccagcuggaaaguuagctt

SEQ ID NO: 604 - DNA, 21 bp, Artificial Sequence
  siRNA
uuggguuccagcuggaaagtt

SEQ ID NO: 605 - DNA, 21 bp, Artificial Sequence
  siRNA
acuugguguggggauugggtt

SEQ ID NO: 606 - DNA, 21 bp, Artificial Sequence
  siRNA
cugauacuugguguggggatt

SEQ ID NO: 607 - DNA, 21 bp, Artificial Sequence
  siRNA
aacuccuccauacugauactt

SEQ ID NO: 608 - DNA, 21 bp, Artificial Sequence
  siRNA
uguuugauccaccacaaagtt

SEQ ID NO: 609 - DNA, 21 bp, Artificial Sequence
  siRNA
aggcccugacacaggaugutt

SEQ ID NO: 610 - DNA, 21 bp, Artificial Sequence
  siRNA
auuuuuaucuacuuccauctt

SEQ ID NO: 611 - DNA, 21 bp, Artificial Sequence
  siRNA
ugagcccauuuuuaucuactt

SEQ ID NO: 612 - DNA, 21 bp, Artificial Sequence
  siRNA
acacaucuugagcccauuutt

SEQ ID NO: 613 - DNA, 21 bp, Artificial Sequence
  siRNA
ucacacaucuugagcccautt

SEQ ID NO: 614 - DNA, 21 bp, Artificial Sequence
  siRNA
cccacaaggcucacacauctt

SEQ ID NO: 615 - DNA, 21 bp, Artificial Sequence
  siRNA
gccuguucccucacaggcutt

SEQ ID NO: 616 - DNA, 21 bp, Artificial Sequence
  siRNA
aagcggcucccagagccugtt

SEQ ID NO: 617 - DNA, 21 bp, Artificial Sequence
  siRNA
guucacaaauccaucaaugtt

SEQ ID NO: 618 - DNA, 21 bp, Artificial Sequence
  siRNA
gcccaggaucuuggugcagtt

SEQ ID NO: 619 - DNA, 21 bp, Artificial Sequence
  siRNA
guccagguugcccaggauctt

SEQ ID NO: 620 - DNA, 21 bp, Artificial Sequence
  siRNA
ggugaucagaaaguccaggtt

SEQ ID NO: 621 - DNA, 21 bp, Artificial Sequence
  siRNA
cuugugccaggggucuccatt

SEQ ID NO: 622 - DNA, 21 bp, Artificial Sequence
  siRNA
uggguccagggcagggauctt

SEQ ID NO: 623 - DNA, 21 bp, Artificial Sequence
  siRNA
uguccggaagacauugagctt

SEQ ID NO: 624 - DNA, 21 bp, Artificial Sequence
  siRNA
ccguacuguccggaagacatt

SEQ ID NO: 625 - DNA, 21 bp, Artificial Sequence
  siRNA
gggcggccaggacuggaugtt

SEQ ID NO: 626 - DNA, 21 bp, Artificial Sequence
  siRNA
auuggaaaaaacacugaagtt

SEQ ID NO: 627 - DNA, 21 bp, Artificial Sequence
  siRNA
gccuccaaugguugucaaatt

SEQ ID NO: 628 - DNA, 21 bp, Artificial Sequence
  siRNA
aggcuucugccuccaauggtt

SEQ ID NO: 629 - DNA, 21 bp, Artificial Sequence
  siRNA
aagccccgguuguagaggctt

SEQ ID NO: 630 - DNA, 21 bp, Artificial Sequence
  siRNA
caacaaugagaagccccggtt

SEQ ID NO: 631 - DNA, 21 bp, Artificial Sequence
  siRNA
agaugugacauucaaguuctt

SEQ ID NO: 632 - DNA, 21 bp, Artificial Sequence
  siRNA
cagagaugugacauucaagtt

SEQ ID NO: 633 - DNA, 21 bp, Artificial Sequence
  siRNA
gaagcccagagaugugacatt

SEQ ID NO: 634 - DNA, 21 bp, Artificial Sequence
  siRNA
acgcccagcacuaauuucctt

SEQ ID NO: 635 - DNA, 21 bp, Artificial Sequence
  siRNA
agauacgcccagcacuaautt

SEQ ID NO: 636 - DNA, 21 bp, Artificial Sequence
  siRNA
cagagcugccuauuggcactt

SEQ ID NO: 637 - DNA, 21 bp, Artificial Sequence
  siRNA
gugguagcagagcugccuatt

SEQ ID NO: 638 - DNA, 21 bp, Artificial Sequence
  siRNA
ccgaagcaccuugguccagtt

SEQ ID NO: 639 - DNA, 21 bp, Artificial Sequence
  siRNA
cguaggcccccgaagcacctt

SEQ ID NO: 640 - DNA, 21 bp, Artificial Sequence
  siRNA
gcuugaugucuagucgcuctt

SEQ ID NO: 641 - DNA, 21 bp, Artificial Sequence
  siRNA
ucugcgcggccgauuaugctt

SEQ ID NO: 642 - DNA, 21 bp, Artificial Sequence
  siRNA
gcagucucugcgcggccgatt

SEQ ID NO: 643 - DNA, 21 bp, Artificial Sequence
  siRNA
gcacagugggucacacacutt

SEQ ID NO: 644 - DNA, 21 bp, Artificial Sequence
  siRNA
acaccuccucggcuauaautt

SEQ ID NO: 645 - DNA, 21 bp, Artificial Sequence
  siRNA
aggcuccccauucagaaagtt

SEQ ID NO: 646 - DNA, 21 bp, Artificial Sequence
  siRNA
aaauucucgaggcuccccatt

SEQ ID NO: 647 - DNA, 21 bp, Artificial Sequence
  siRNA
auucggccucaugggcaaatt

SEQ ID NO: 648 - DNA, 21 bp, Artificial Sequence
  siRNA
ccggguggcaggagaagcatt

SEQ ID NO: 649 - DNA, 21 bp, Artificial Sequence
  siRNA
ugcccuccauggguuggcatt

SEQ ID NO: 650 - DNA, 21 bp, Artificial Sequence
  siRNA
uggcagugcccuccaugggtt

SEQ ID NO: 651 - DNA, 21 bp, Artificial Sequence
  siRNA
aguaucagagcccgagccatt

SEQ ID NO: 652 - DNA, 21 bp, Artificial Sequence
  siRNA
caucucgaaaaugggcacatt

SEQ ID NO: 653 - DNA, 21 bp, Artificial Sequence
  siRNA
guacuuguagauugggccctt

SEQ ID NO: 654 - DNA, 21 bp, Artificial Sequence
  siRNA
acaucuggguacuuguagatt

SEQ ID NO: 655 - DNA, 21 bp, Artificial Sequence
  siRNA
auucugaacaucuggguactt

SEQ ID NO: 656 - DNA, 21 bp, Artificial Sequence
  siRNA
auggcagggccgacauucatt

SEQ ID NO: 657 - DNA, 21 bp, Artificial Sequence
  siRNA
ucucauggcagggccgacatt

SEQ ID NO: 658 - DNA, 21 bp, Artificial Sequence
  siRNA
uuuacaccccugggugcagtt

SEQ ID NO: 659 - DNA, 21 bp, Artificial Sequence
  siRNA
gucuugaagcucugguccutt

SEQ ID NO: 660 - DNA, 21 bp, Artificial Sequence
  siRNA
guguuuguccuaaacaguctt

SEQ ID NO: 661 - DNA, 21 bp, Artificial Sequence
  siRNA
ugccgaucagcaccagugutt

SEQ ID NO: 662 - DNA, 21 bp, Artificial Sequence
  siRNA
agccauugucagauggguutt

SEQ ID NO: 663 - DNA, 21 bp, Artificial Sequence
  siRNA
aaagccauugucagaugggtt

SEQ ID NO: 664 - DNA, 21 bp, Artificial Sequence
  siRNA
gcuaucacugucaaagccatt

SEQ ID NO: 665 - DNA, 21 bp, Artificial Sequence
  siRNA
ucgccucauagcccuuuuatt

SEQ ID NO: 666 - DNA, 21 bp, Artificial Sequence
  siRNA
guaucgccucauagcccuutt

SEQ ID NO: 667 - DNA, 21 bp, Artificial Sequence
  siRNA
aaguaucgccucauagccctt

SEQ ID NO: 668 - DNA, 21 bp, Artificial Sequence
  siRNA
gcucuaugcucucaccccgtt

SEQ ID NO: 669 - DNA, 21 bp, Artificial Sequence
  siRNA
ggccaagacuuuguuagcctt

SEQ ID NO: 670 - DNA, 21 bp, Artificial Sequence
  siRNA
gauucuggccaagacuuugtt

SEQ ID NO: 671 - DNA, 21 bp, Artificial Sequence
  siRNA
gaagauucuggccaagacutt

SEQ ID NO: 672 - DNA, 21 bp, Artificial Sequence
  siRNA
agcucugucucuuugaagatt

SEQ ID NO: 673 - DNA, 21 bp, Artificial Sequence
  siRNA
cuuccuuagcucugucucutt

SEQ ID NO: 674 - DNA, 21 bp, Artificial Sequence
  siRNA
ccaagcacuuuaagcuucctt

SEQ ID NO: 675 - DNA, 21 bp, Artificial Sequence
  siRNA
cgagccaagcacuuuaagctt

SEQ ID NO: 676 - DNA, 21 bp, Artificial Sequence
  siRNA
gacacccgagccaagcacutt

SEQ ID NO: 677 - DNA, 21 bp, Artificial Sequence
  siRNA
cacacuccuuugugcacagtt

SEQ ID NO: 678 - DNA, 21 bp, Artificial Sequence
  siRNA
cucagggauccacacuccutt

SEQ ID NO: 679 - DNA, 21 bp, Artificial Sequence
  siRNA
agacuggaaucuugauugatt

SEQ ID NO: 680 - DNA, 21 bp, Artificial Sequence
  siRNA
augcagacuggaaucuugatt

SEQ ID NO: 681 - DNA, 21 bp, Artificial Sequence
  siRNA
uuuaaugcagacuggaauctt

SEQ ID NO: 682 - DNA, 21 bp, Artificial Sequence
  siRNA
acucuuguccucaaugacutt

SEQ ID NO: 683 - DNA, 21 bp, Artificial Sequence
  siRNA
aaaacucugccguccacuctt

SEQ ID NO: 684 - DNA, 21 bp, Artificial Sequence
  siRNA
gcauaugaucugucacagctt

SEQ ID NO: 685 - DNA, 21 bp, Artificial Sequence
  siRNA
gggcauagucccagcagcctt

SEQ ID NO: 686 - DNA, 21 bp, Artificial Sequence
  siRNA
gagaacccagaggcaaauatt

SEQ ID NO: 687 - DNA, 21 bp, Artificial Sequence
  siRNA
gccccagugccccccggugtt

SEQ ID NO: 688 - DNA, 21 bp, Artificial Sequence
  siRNA
ggcaauuuguacuccccagtt

SEQ ID NO: 689 - DNA, 21 bp, Artificial Sequence
  siRNA
aguacauucccuuggcaautt

SEQ ID NO: 690 - DNA, 21 bp, Artificial Sequence
  siRNA
cucaagguaguacauuccctt

SEQ ID NO: 691 - DNA, 21 bp, Artificial Sequence
  siRNA
uguuccucaagguaguacatt

SEQ ID NO: 692 - DNA, 21 bp, Artificial Sequence
  siRNA
uucuaugcaccauaccaugtt

SEQ ID NO: 693 - DNA, 21 bp, Artificial Sequence
  siRNA
acguuucgggcagccaggutt

SEQ ID NO: 694 - DNA, 21 bp, Artificial Sequence
  siRNA
ggugacuugaguagcacgutt

SEQ ID NO: 695 - DNA, 21 bp, Artificial Sequence
  siRNA
cugaaccugacugggugactt

SEQ ID NO: 696 - DNA, 21 bp, Artificial Sequence
  siRNA
cucacuguauagcagcugctt

SEQ ID NO: 697 - DNA, 21 bp, Artificial Sequence
  siRNA
cauccacuuaauuggaguctt

SEQ ID NO: 698 - DNA, 21 bp, Artificial Sequence
  siRNA
ucaagggccauccacuuaatt

SEQ ID NO: 699 - DNA, 21 bp, Artificial Sequence
  siRNA
acucucaagggccauccactt

SEQ ID NO: 700 - DNA, 21 bp, Artificial Sequence
  siRNA
aucacucugguguguguautt

SEQ ID NO: 701 - DNA, 21 bp, Artificial Sequence
  siRNA
ucucuagcaggucugguactt

SEQ ID NO: 702 - DNA, 21 bp, Artificial Sequence
  siRNA
cugugccaaccgcuccccctt

SEQ ID NO: 703 - DNA, 21 bp, Artificial Sequence
  siRNA
aucaccauguagacaucaatt

SEQ ID NO: 704 - DNA, 21 bp, Artificial Sequence
  siRNA
cucaucaaucauccaacactt

SEQ ID NO: 705 - DNA, 21 bp, Artificial Sequence
  siRNA
uuuaaagguugggcgaaugtt

SEQ ID NO: 706 - DNA, 21 bp, Artificial Sequence
  siRNA
uuggcuaguucuuuaaaggtt

SEQ ID NO: 707 - DNA, 21 bp, Artificial Sequence
  siRNA
gaacucauuggcuaguucutt

SEQ ID NO: 708 - DNA, 21 bp, Artificial Sequence
  siRNA
uggugaacucauuggcuagtt

SEQ ID NO: 709 - DNA, 21 bp, Artificial Sequence
  siRNA
ggccauccuggugaacucatt

SEQ ID NO: 710 - DNA, 21 bp, Artificial Sequence
  siRNA
ccaggcccacucucucucutt

SEQ ID NO: 711 - DNA, 21 bp, Artificial Sequence
  siRNA
ggcucuggcccaggggcuatt

SEQ ID NO: 712 - DNA, 21 bp, Artificial Sequence
  siRNA
acuuccucuagcuucuugutt

SEQ ID NO: 713 - DNA, 21 bp, Artificial Sequence
  siRNA
cucuacuuccucuagcuuctt

SEQ ID NO: 714 - DNA, 21 bp, Artificial Sequence
  siRNA
cagcucuacuuccucuagctt

SEQ ID NO: 715 - DNA, 21 bp, Artificial Sequence
  siRNA
guucuggcuccagcucuactt

SEQ ID NO: 716 - DNA, 21 bp, Artificial Sequence
  siRNA
agucuaggucuaggucuagtt

SEQ ID NO: 717 - DNA, 21 bp, Artificial Sequence
  siRNA
ccagguuguccuccucugctt

SEQ ID NO: 718 - DNA, 21 bp, Artificial Sequence
  siRNA
caguguggugguugccaggtt

SEQ ID NO: 719 - DNA, 21 bp, Artificial Sequence
  siRNA
gcggagcccagugugguggtt

SEQ ID NO: 720 - DNA, 21 bp, Artificial Sequence
  siRNA
ccacguggccgauuaagugtt

SEQ ID NO: 721 - DNA, 21 bp, Artificial Sequence
  siRNA
cuggcucccacguggccgatt

SEQ ID NO: 722 - DNA, 21 bp, Artificial Sequence
  siRNA
auguauccagaugauggactt

SEQ ID NO: 723 - DNA, 21 bp, Artificial Sequence
  siRNA
cuccccaagauuacccuggtt

SEQ ID NO: 724 - DNA, 21 bp, Artificial Sequence
  siRNA
cuggcaagacuccccaagatt

SEQ ID NO: 725 - DNA, 21 bp, Artificial Sequence
  siRNA
agacuggacgggggcaccgtt

SEQ ID NO: 726 - DNA, 21 bp, Artificial Sequence
  siRNA
gccaggcauccccguggcatt

SEQ ID NO: 727 - DNA, 21 bp, Artificial Sequence
  siRNA
agcucagccucagagccugtt

SEQ ID NO: 728 - DNA, 21 bp, Artificial Sequence
  siRNA
gcuccuacacauugacacutt

SEQ ID NO: 729 - DNA, 21 bp, Artificial Sequence
  siRNA
cugcuccggcuccuacacatt

SEQ ID NO: 730 - DNA, 21 bp, Artificial Sequence
  siRNA
cauaaccguugacauccuctt

SEQ ID NO: 731 - DNA, 21 bp, Artificial Sequence
  siRNA
aucuggcaugacauaaccgtt

SEQ ID NO: 732 - DNA, 21 bp, Artificial Sequence
  siRNA
ccgggaggagggaguaccutt

SEQ ID NO: 733 - DNA, 21 bp, Artificial Sequence
  siRNA
ccacugaagaaagggugcctt

SEQ ID NO: 734 - DNA, 21 bp, Artificial Sequence
  siRNA
ccucaucuucaucuucuuctt

SEQ ID NO: 735 - DNA, 21 bp, Artificial Sequence
  siRNA
acuccucaucuucaucuuctt

SEQ ID NO: 736 - DNA, 21 bp, Artificial Sequence
  siRNA
cauacuccucaucuucauctt

SEQ ID NO: 737 - DNA, 21 bp, Artificial Sequence
  siRNA
uguauucauacuccucauctt

SEQ ID NO: 738 - DNA, 21 bp, Artificial Sequence
  siRNA
uucuccuccgguucauguatt

SEQ ID NO: 739 - DNA, 21 bp, Artificial Sequence
  siRNA
acugugccuucuccuccggtt

SEQ ID NO: 740 - DNA, 21 bp, Artificial Sequence
  siRNA
ggaugagguggacugugcctt

SEQ ID NO: 741 - DNA, 21 bp, Artificial Sequence
  siRNA
cccagcuccucaagggaactt

SEQ ID NO: 742 - DNA, 21 bp, Artificial Sequence
  siRNA
ucauagucuucaucuggagtt

SEQ ID NO: 743 - DNA, 21 bp, Artificial Sequence
  siRNA
gauucauauauucauaguctt

SEQ ID NO: 744 - DNA, 21 bp, Artificial Sequence
  siRNA
cucguugccgauucauauatt

SEQ ID NO: 745 - DNA, 21 bp, Artificial Sequence
  siRNA
accuccaucucguugccgatt

SEQ ID NO: 746 - DNA, 21 bp, Artificial Sequence
  siRNA
caggaccaccuccaucucgtt

SEQ ID NO: 747 - DNA, 21 bp, Artificial Sequence
  siRNA
cucucaucucuucauaccctt

SEQ ID NO: 748 - DNA, 21 bp, Artificial Sequence
  siRNA
ccugaaaagcucucaucuctt

SEQ ID NO: 749 - DNA, 21 bp, Artificial Sequence
  siRNA
ucuaagcuacguagaguuutt

SEQ ID NO: 750 - DNA, 21 bp, Artificial Sequence
  siRNA
ccucuaagcuacguagagutt

SEQ ID NO: 751 - DNA, 21 bp, Artificial Sequence
  siRNA
gcuaugccaguaaucagggtt

SEQ ID NO: 752 - DNA, 21 bp, Artificial Sequence
  siRNA
cguucucugggcauuagcctt

SEQ ID NO: 753 - DNA, 21 bp, Artificial Sequence
  siRNA
gaguuacguucucugggcatt

SEQ ID NO: 754 - DNA, 21 bp, Artificial Sequence
  siRNA
acagggagcaggaguuacgtt

SEQ ID NO: 755 - DNA, 21 bp, Artificial Sequence
  siRNA
gugccacagggagcaggagtt

SEQ ID NO: 756 - DNA, 21 bp, Artificial Sequence
  siRNA
cuaaaggcacuagcugccatt

SEQ ID NO: 757 - DNA, 21 bp, Artificial Sequence
  siRNA
cuccaaagauugaauggaatt

SEQ ID NO: 758 - DNA, 21 bp, Artificial Sequence
  siRNA
guuuaaaagccuccaaagatt

SEQ ID NO: 759 - DNA, 21 bp, Artificial Sequence
  siRNA
gaauuuugugucaaaaugutt

SEQ ID NO: 760 - DNA, 21 bp, Artificial Sequence
  siRNA
gcuacauaccauaagaauutt

SEQ ID NO: 761 - DNA, 21 bp, Artificial Sequence
  siRNA
uggcuacauaccauaagaatt

SEQ ID NO: 762 - DNA, 21 bp, Artificial Sequence
  siRNA
aggaaaaccuuuccuggggtt

SEQ ID NO: 763 - DNA, 21 bp, Artificial Sequence
  siRNA
cacaaaauaaggaaaaccutt

SEQ ID NO: 764 - DNA, 21 bp, Artificial Sequence
  siRNA
gggauauggagaguaaucctt

SEQ ID NO: 765 - DNA, 21 bp, Artificial Sequence
  siRNA
ggcacacauaagagccuagtt

SEQ ID NO: 766 - DNA, 21 bp, Artificial Sequence
  siRNA
uuuccucccuuuccucuuctt

SEQ ID NO: 767 - DNA, 21 bp, Artificial Sequence
  siRNA
agguuuccucccuuuccuctt

SEQ ID NO: 768 - DNA, 21 bp, Artificial Sequence
  siRNA
ucugcuagguuuccucccutt

SEQ ID NO: 769 - DNA, 21 bp, Artificial Sequence
  siRNA
acacuuuccucugcuaggutt

SEQ ID NO: 770 - DNA, 21 bp, Artificial Sequence
  siRNA
cauaaaccaaaauuacacutt

SEQ ID NO: 771 - DNA, 21 bp, Artificial Sequence
  siRNA
uaagagucauaaaccaaaatt

SEQ ID NO: 772 - DNA, 21 bp, Artificial Sequence
  siRNA
cuucugucuuucuagggggtt

SEQ ID NO: 773 - DNA, 21 bp, Artificial Sequence
  siRNA
agauuuuaagcuucugucutt

SEQ ID NO: 774 - DNA, 21 bp, Artificial Sequence
  siRNA
uucuucacagauuuuaagctt

SEQ ID NO: 775 - DNA, 21 bp, Artificial Sequence
  siRNA
accucuuucuucacagauutt

SEQ ID NO: 776 - DNA, 21 bp, Artificial Sequence
  siRNA
uaaccucuuucuucacagatt

SEQ ID NO: 777 - DNA, 21 bp, Artificial Sequence
  siRNA
ucuacuccuaaccucuuuctt

SEQ ID NO: 778 - DNA, 21 bp, Artificial Sequence
  siRNA
auaucuacuccuaaccucutt

SEQ ID NO: 779 - DNA, 21 bp, Artificial Sequence
  siRNA
cucauaguuaagugcugaatt

SEQ ID NO: 780 - DNA, 21 bp, Artificial Sequence
  siRNA
uaugaugccuggcucauagtt

SEQ ID NO: 781 - DNA, 21 bp, Artificial Sequence
  siRNA
gagauaauguaggugaagutt

SEQ ID NO: 782 - DNA, 21 bp, Artificial Sequence
  siRNA
uguaugucacagaauuguutt

SEQ ID NO: 783 - DNA, 21 bp, Artificial Sequence
  siRNA
uauguaugucacagaauugtt

SEQ ID NO: 784 - DNA, 21 bp, Artificial Sequence
  siRNA
uaauauguaugucacagaatt

SEQ ID NO: 785 - DNA, 21 bp, Artificial Sequence
  siRNA
caccaugcccgacuucccutt

SEQ ID NO: 786 - DNA, 21 bp, Artificial Sequence
  siRNA
augagccaccaugcccgactt

SEQ ID NO: 787 - DNA, 21 bp, Artificial Sequence
  siRNA
gccucccaaagugcugagatt

SEQ ID NO: 788 - DNA, 21 bp, Artificial Sequence
  siRNA
uccuugccucagguaaucctt

SEQ ID NO: 789 - DNA, 21 bp, Artificial Sequence
  siRNA
uaagcuggucucaaacucctt

SEQ ID NO: 790 - DNA, 21 bp, Artificial Sequence
  siRNA
agaugggggucuuacuaugtt

SEQ ID NO: 791 - DNA, 21 bp, Artificial Sequence
  siRNA
uuuuaaagagauggggguctt

SEQ ID NO: 792 - DNA, 21 bp, Artificial Sequence
  siRNA
uuuuuuuuuuuuuuuuuuutt

SEQ ID NO: 793 - DNA, 21 bp, Artificial Sequence
  siRNA
guuuuuuuuuuuuuuuuuutt

SEQ ID NO: 794 - DNA, 21 bp, Artificial Sequence
  siRNA
aaguuuuuuuuuuuuuuuutt

SEQ ID NO: 795 - DNA, 21 bp, Artificial Sequence
  siRNA
uaaaguuuuuuuuuuuuuutt

SEQ ID NO: 796 - DNA, 21 bp, Artificial Sequence
  siRNA
ucuaaaguuuuuuuuuuuutt

SEQ ID NO: 797 - DNA, 21 bp, Artificial Sequence
  siRNA
guucuaaaguuuuuuuuuutt

SEQ ID NO: 798 - DNA, 21 bp, Artificial Sequence
  siRNA
caguucuaaaguuuuuuuutt

SEQ ID NO: 799 - DNA, 21 bp, Artificial Sequence
  siRNA
cccaguucuaaaguuuuuutt

SEQ ID NO: 800 - DNA, 21 bp, Artificial Sequence
  siRNA
cacccaguucuaaaguuuutt

SEQ ID NO: 801 - DNA, 21 bp, Artificial Sequence
  siRNA
ugcacccaguucuaaaguutt

SEQ ID NO: 802 - DNA, 21 bp, Artificial Sequence
  siRNA
acugcacccaguucuaaagtt

SEQ ID NO: 803 - DNA, 21 bp, Artificial Sequence
  siRNA
caugagccacugcacccagtt

SEQ ID NO: 804 - DNA, 21 bp, Artificial Sequence
  siRNA
cccaaagugcuggcugggatt

SEQ ID NO: 805 - DNA, 21 bp, Artificial Sequence
  siRNA
auucugggcucaagugauctt

SEQ ID NO: 806 - DNA, 21 bp, Artificial Sequence
  siRNA
uccauaggcuuaucucuaatt

SEQ ID NO: 807 - DNA, 21 bp, Artificial Sequence
  siRNA
uugcuauguuuccauaggctt

SEQ ID NO: 808 - DNA, 21 bp, Artificial Sequence
  siRNA
agacagugucuugcuaugutt

SEQ ID NO: 809 - DNA, 21 bp, Artificial Sequence
  siRNA
ccccuguagagacaguguctt

SEQ ID NO: 810 - DNA, 21 bp, Artificial Sequence
  siRNA
cucaguuucuuuuuuuuuutt

SEQ ID NO: 811 - DNA, 21 bp, Artificial Sequence
  siRNA
ggcucaguuucuuuuuuuutt

SEQ ID NO: 812 - DNA, 21 bp, Artificial Sequence
  siRNA
aaggcucaguuucuuuuuutt

SEQ ID NO: 813 - DNA, 21 bp, Artificial Sequence
  siRNA
uuaaggcucaguuucuuuutt

SEQ ID NO: 814 - DNA, 21 bp, Artificial Sequence
  siRNA
cuuuaaggcucaguuucuutt

SEQ ID NO: 815 - DNA, 21 bp, Artificial Sequence
  siRNA
cucuuuaaggcucaguuuctt

SEQ ID NO: 816 - DNA, 21 bp, Artificial Sequence
  siRNA
caucucuuuaaggcucagutt

SEQ ID NO: 817 - DNA, 21 bp, Artificial Sequence
  siRNA
cuuaauuuauuucaucucutt

SEQ ID NO: 818 - DNA, 21 bp, Artificial Sequence
  siRNA
gaucuacugcuuaauuuautt

SEQ ID NO: 819 - DNA, 21 bp, Artificial Sequence
  siRNA
ccuggaucuacugcuuaautt

SEQ ID NO: 820 - DNA, 21 bp, Artificial Sequence
  siRNA
ugcauccuggaucuacugctt

SEQ ID NO: 821 - DNA, 21 bp, Artificial Sequence
  siRNA
cacaggaauugggaggauutt

SEQ ID NO: 822 - DNA, 21 bp, Artificial Sequence
  siRNA
ugcacaggaauugggaggatt

SEQ ID NO: 823 - DNA, 21 bp, Artificial Sequence
  siRNA
aagagcacaugcacaggaatt

SEQ ID NO: 824 - DNA, 21 bp, Artificial Sequence
  siRNA
aucaguuuuucuuggcacctt

SEQ ID NO: 825 - DNA, 21 bp, Artificial Sequence
  siRNA
uaacuuaaaucaguuuuuctt

SEQ ID NO: 826 - DNA, 21 bp, Artificial Sequence
  siRNA
cuguaacuuaaaucaguuutt

SEQ ID NO: 827 - DNA, 21 bp, Artificial Sequence
  siRNA
ggcuguaacuuaaaucagutt

SEQ ID NO: 828 - DNA, 21 bp, Artificial Sequence
  siRNA
cuuaaacaagggcuguaactt

SEQ ID NO: 829 - DNA, 21 bp, Artificial Sequence
  siRNA
aaacaagaaacagugcccctt

SEQ ID NO: 830 - DNA, 21 bp, Artificial Sequence
  siRNA
cuguugggguuagacuugatt

SEQ ID NO: 831 - DNA, 21 bp, Artificial Sequence
  siRNA
guggcuguugggguuagactt

SEQ ID NO: 832 - DNA, 21 bp, Artificial Sequence
  siRNA
gaggauguggcuguuggggtt

SEQ ID NO: 833 - DNA, 21 bp, Artificial Sequence
  siRNA
guauaggaggauguggcugtt

SEQ ID NO: 834 - DNA, 21 bp, Artificial Sequence
  siRNA
ugacuacccccaccaccactt

SEQ ID NO: 835 - DNA, 21 bp, Artificial Sequence
  siRNA
gauguccaguuauuuuucctt

SEQ ID NO: 836 - DNA, 21 bp, Artificial Sequence
  siRNA
caaagauguccaguuauuutt

SEQ ID NO: 837 - DNA, 21 bp, Artificial Sequence
  siRNA
cacaaagauguccaguuautt

SEQ ID NO: 838 - DNA, 21 bp, Artificial Sequence
  siRNA
uuuacacaaagauguccagtt

SEQ ID NO: 839 - DNA, 21 bp, Artificial Sequence
  siRNA
ggcacauguggauuauggutt

SEQ ID NO: 840 - DNA, 21 bp, Artificial Sequence
  siRNA
cauuuacggcacauguggatt

SEQ ID NO: 841 - DNA, 21 bp, Artificial Sequence
  siRNA
gauaaggagugaagaucautt

SEQ ID NO: 842 - DNA, 21 bp, Artificial Sequence
  siRNA
cuuggggauccuugugaautt

SEQ ID NO: 843 - DNA, 21 bp, Artificial Sequence
  siRNA
aaguggaucuuggggaucctt

SEQ ID NO: 844 - DNA, 21 bp, Artificial Sequence
  siRNA
uggcuucuaaaaguggauctt

SEQ ID NO: 845 - DNA, 21 bp, Artificial Sequence
  siRNA
uuugcaaccuccgcugccgtt

SEQ ID NO: 846 - DNA, 21 bp, Artificial Sequence
  siRNA
ccuccgcugccgucgccgctt

SEQ ID NO: 847 - DNA, 21 bp, Artificial Sequence
  siRNA
uucgccagcgguucaggugtt

SEQ ID NO: 848 - DNA, 21 bp, Artificial Sequence
  siRNA
cgacgcucugcaggugcugtt

SEQ ID NO: 849 - DNA, 21 bp, Artificial Sequence
  siRNA
cucucaggcaguguguccutt

SEQ ID NO: 850 - DNA, 21 bp, Artificial Sequence
  siRNA
uggccugagugugaccggctt

SEQ ID NO: 851 - DNA, 21 bp, Artificial Sequence
  siRNA
ccaauaccagacacuguactt

SEQ ID NO: 852 - DNA, 21 bp, Artificial Sequence
  siRNA
uaccagacacuguacaagctt

SEQ ID NO: 853 - DNA, 21 bp, Artificial Sequence
  siRNA
gcucuacgagaggugugagtt

SEQ ID NO: 854 - DNA, 21 bp, Artificial Sequence
  siRNA
ccuugagauugugcucacgtt

SEQ ID NO: 855 - DNA, 21 bp, Artificial Sequence
  siRNA
ugccgaccucuccuuccugtt

SEQ ID NO: 856 - DNA, 21 bp, Artificial Sequence
  siRNA
gugacaggcuauguccucgtt

SEQ ID NO: 857 - DNA, 21 bp, Artificial Sequence
  siRNA
ugaauucucuacucuaccatt

SEQ ID NO: 858 - DNA, 21 bp, Artificial Sequence
  siRNA
uucucuacucuaccauugctt

SEQ ID NO: 859 - DNA, 21 bp, Artificial Sequence
  siRNA
ccuccgcguggugcgagggtt

SEQ ID NO: 860 - DNA, 21 bp, Artificial Sequence
  siRNA
guuugccaucuucgucaugtt

SEQ ID NO: 861 - DNA, 21 bp, Artificial Sequence
  siRNA
cuauaacaccaacuccagctt

SEQ ID NO: 862 - DNA, 21 bp, Artificial Sequence
  siRNA
caccaacuccagccacgcutt

SEQ ID NO: 863 - DNA, 21 bp, Artificial Sequence
  siRNA
cuccagccacgcucugcgctt

SEQ ID NO: 864 - DNA, 21 bp, Artificial Sequence
  siRNA
gaacgauaagcuuugucactt

SEQ ID NO: 865 - DNA, 21 bp, Artificial Sequence
  siRNA
cgauaagcuuugucacaugtt

SEQ ID NO: 866 - DNA, 21 bp, Artificial Sequence
  siRNA
gcuuugucacauggacacatt

SEQ ID NO: 867 - DNA, 21 bp, Artificial Sequence
  siRNA
uugacuggagggacaucgutt

SEQ ID NO: 868 - DNA, 21 bp, Artificial Sequence
  siRNA
ggacaauggcagaagcugutt

SEQ ID NO: 869 - DNA, 21 bp, Artificial Sequence
  siRNA
uggcagaagcugucccccctt

SEQ ID NO: 870 - DNA, 21 bp, Artificial Sequence
  siRNA
gcuguccccccugucaugatt

SEQ ID NO: 871 - DNA, 21 bp, Artificial Sequence
  siRNA
ggggcgaugcugggguccutt

SEQ ID NO: 872 - DNA, 21 bp, Artificial Sequence
  siRNA
gacugccagacauugaccatt

SEQ ID NO: 873 - DNA, 21 bp, Artificial Sequence
  siRNA
gaccaucugugcuccucagtt

SEQ ID NO: 874 - DNA, 21 bp, Artificial Sequence
  siRNA
uggucacugcuuugggccctt

SEQ ID NO: 875 - DNA, 21 bp, Artificial Sequence
  siRNA
ccccaaccagugcugccautt

SEQ ID NO: 876 - DNA, 21 bp, Artificial Sequence
  siRNA
ccagugcugccaugaugagtt

SEQ ID NO: 877 - DNA, 21 bp, Artificial Sequence
  siRNA
ugacaguggagccuguguatt

SEQ ID NO: 878 - DNA, 21 bp, Artificial Sequence
  siRNA
caagcuaacuuuccagcugtt

SEQ ID NO: 879 - DNA, 21 bp, Artificial Sequence
  siRNA
gcuaacuuuccagcuggaatt

SEQ ID NO: 880 - DNA, 21 bp, Artificial Sequence
  siRNA
cuuuccagcuggaacccaatt

SEQ ID NO: 881 - DNA, 21 bp, Artificial Sequence
  siRNA
cccaauccccacaccaagutt

SEQ ID NO: 882 - DNA, 21 bp, Artificial Sequence
  siRNA
uccccacaccaaguaucagtt

SEQ ID NO: 883 - DNA, 21 bp, Artificial Sequence
  siRNA
guaucaguauggaggaguutt

SEQ ID NO: 884 - DNA, 21 bp, Artificial Sequence
  siRNA
cuuugugguggaucaaacatt

SEQ ID NO: 885 - DNA, 21 bp, Artificial Sequence
  siRNA
acauccugugucagggccutt

SEQ ID NO: 886 - DNA, 21 bp, Artificial Sequence
  siRNA
gauggaaguagauaaaaautt

SEQ ID NO: 887 - DNA, 21 bp, Artificial Sequence
  siRNA
guagauaaaaaugggcucatt

SEQ ID NO: 888 - DNA, 21 bp, Artificial Sequence
  siRNA
aaaugggcucaagaugugutt

SEQ ID NO: 889 - DNA, 21 bp, Artificial Sequence
  siRNA
augggcucaagaugugugatt

SEQ ID NO: 890 - DNA, 21 bp, Artificial Sequence
  siRNA
gaugugugagccuugugggtt

SEQ ID NO: 891 - DNA, 21 bp, Artificial Sequence
  siRNA
agccugugagggaacaggctt

SEQ ID NO: 892 - DNA, 21 bp, Artificial Sequence
  siRNA
caggcucugggagccgcuutt

SEQ ID NO: 893 - DNA, 21 bp, Artificial Sequence
  siRNA
cauugauggauuugugaactt

SEQ ID NO: 894 - DNA, 21 bp, Artificial Sequence
  siRNA
cugcaccaagauccugggctt

SEQ ID NO: 895 - DNA, 21 bp, Artificial Sequence
  siRNA
gauccugggcaaccuggactt

SEQ ID NO: 896 - DNA, 21 bp, Artificial Sequence
  siRNA
ccuggacuuucugaucacctt

SEQ ID NO: 897 - DNA, 21 bp, Artificial Sequence
  siRNA
uggagaccccuggcacaagtt

SEQ ID NO: 898 - DNA, 21 bp, Artificial Sequence
  siRNA
gaucccugcccuggacccatt

SEQ ID NO: 899 - DNA, 21 bp, Artificial Sequence
  siRNA
gcucaaugucuuccggacatt

SEQ ID NO: 900 - DNA, 21 bp, Artificial Sequence
  siRNA
ugucuuccggacaguacggtt

SEQ ID NO: 901 - DNA, 21 bp, Artificial Sequence
  siRNA
cauccaguccuggccgccctt

SEQ ID NO: 902 - DNA, 21 bp, Artificial Sequence
  siRNA
cuucaguguuuuuuccaautt

SEQ ID NO: 903 - DNA, 21 bp, Artificial Sequence
  siRNA
uuugacaaccauuggaggctt

SEQ ID NO: 904 - DNA, 21 bp, Artificial Sequence
  siRNA
ccauuggaggcagaagccutt

SEQ ID NO: 905 - DNA, 21 bp, Artificial Sequence
  siRNA
gccucuacaaccggggcuutt

SEQ ID NO: 906 - DNA, 21 bp, Artificial Sequence
  siRNA
ccggggcuucucauuguugtt

SEQ ID NO: 907 - DNA, 21 bp, Artificial Sequence
  siRNA
gaacuugaaugucacaucutt

SEQ ID NO: 908 - DNA, 21 bp, Artificial Sequence
  siRNA
cuugaaugucacaucucugtt

SEQ ID NO: 909 - DNA, 21 bp, Artificial Sequence
  siRNA
ugucacaucucugggcuuctt

SEQ ID NO: 910 - DNA, 21 bp, Artificial Sequence
  siRNA
ggaaauuagugcugggcgutt

SEQ ID NO: 911 - DNA, 21 bp, Artificial Sequence
  siRNA
auuagugcugggcguaucutt

SEQ ID NO: 912 - DNA, 21 bp, Artificial Sequence
  siRNA
gugccaauaggcagcucugtt

SEQ ID NO: 913 - DNA, 21 bp, Artificial Sequence
  siRNA
uaggcagcucugcuaccactt

SEQ ID NO: 914 - DNA, 21 bp, Artificial Sequence
  siRNA
cuggaccaaggugcuucggtt

SEQ ID NO: 915 - DNA, 21 bp, Artificial Sequence
  siRNA
ggugcuucgggggccuacgtt

SEQ ID NO: 916 - DNA, 21 bp, Artificial Sequence
  siRNA
gagcgacuagacaucaagctt

SEQ ID NO: 917 - DNA, 21 bp, Artificial Sequence
  siRNA
gcauaaucggccgcgcagatt

SEQ ID NO: 918 - DNA, 21 bp, Artificial Sequence
  siRNA
ucggccgcgcagagacugctt

SEQ ID NO: 919 - DNA, 21 bp, Artificial Sequence
  siRNA
agugugugacccacugugctt

SEQ ID NO: 920 - DNA, 21 bp, Artificial Sequence
  siRNA
auuauagccgaggaggugutt

SEQ ID NO: 921 - DNA, 21 bp, Artificial Sequence
  siRNA
cuuucugaauggggagccutt

SEQ ID NO: 922 - DNA, 21 bp, Artificial Sequence
  siRNA
uggggagccucgagaauuutt

SEQ ID NO: 923 - DNA, 21 bp, Artificial Sequence
  siRNA
uuugcccaugaggccgaautt

SEQ ID NO: 924 - DNA, 21 bp, Artificial Sequence
  siRNA
ugcuucuccugccacccggtt

SEQ ID NO: 925 - DNA, 21 bp, Artificial Sequence
  siRNA
ugccaacccauggagggcatt

SEQ ID NO: 926 - DNA, 21 bp, Artificial Sequence
  siRNA
cccauggagggcacugccatt

SEQ ID NO: 927 - DNA, 21 bp, Artificial Sequence
  siRNA
uggcucgggcucugauacutt

SEQ ID NO: 928 - DNA, 21 bp, Artificial Sequence
  siRNA
ugugcccauuuucgagaugtt

SEQ ID NO: 929 - DNA, 21 bp, Artificial Sequence
  siRNA
gggcccaaucuacaaguactt

SEQ ID NO: 930 - DNA, 21 bp, Artificial Sequence
  siRNA
ucuacaaguacccagaugutt

SEQ ID NO: 931 - DNA, 21 bp, Artificial Sequence
  siRNA
guacccagauguucagaautt

SEQ ID NO: 932 - DNA, 21 bp, Artificial Sequence
  siRNA
ugaaugucggcccugccautt

SEQ ID NO: 933 - DNA, 21 bp, Artificial Sequence
  siRNA
ugucggcccugccaugagatt

SEQ ID NO: 934 - DNA, 21 bp, Artificial Sequence
  siRNA
cugcacccagggguguaaatt

SEQ ID NO: 935 - DNA, 21 bp, Artificial Sequence
  siRNA
aggaccagagcuucaagactt

SEQ ID NO: 936 - DNA, 21 bp, Artificial Sequence
  siRNA
gacuguuuaggacaaacactt

SEQ ID NO: 937 - DNA, 21 bp, Artificial Sequence
  siRNA
acacuggugcugaucggcatt

SEQ ID NO: 938 - DNA, 21 bp, Artificial Sequence
  siRNA
aacccaucugacaauggcutt

SEQ ID NO: 939 - DNA, 21 bp, Artificial Sequence
  siRNA
cccaucugacaauggcuuutt

SEQ ID NO: 940 - DNA, 21 bp, Artificial Sequence
  siRNA
uggcuuugacagugauagctt

SEQ ID NO: 941 - DNA, 21 bp, Artificial Sequence
  siRNA
uaaaagggcuaugaggcgatt

SEQ ID NO: 942 - DNA, 21 bp, Artificial Sequence
  siRNA
aagggcuaugaggcgauactt

SEQ ID NO: 943 - DNA, 21 bp, Artificial Sequence
  siRNA
gggcuaugaggcgauacuutt

SEQ ID NO: 944 - DNA, 21 bp, Artificial Sequence
  siRNA
cggggugagagcauagagctt

SEQ ID NO: 945 - DNA, 21 bp, Artificial Sequence
  siRNA
ggcuaacaaagucuuggcctt

SEQ ID NO: 946 - DNA, 21 bp, Artificial Sequence
  siRNA
caaagucuuggccagaauctt

SEQ ID NO: 947 - DNA, 21 bp, Artificial Sequence
  siRNA
agucuuggccagaaucuuctt

SEQ ID NO: 948 - DNA, 21 bp, Artificial Sequence
  siRNA
ucuucaaagagacagagcutt

SEQ ID NO: 949 - DNA, 21 bp, Artificial Sequence
  siRNA
agagacagagcuaaggaagtt

SEQ ID NO: 950 - DNA, 21 bp, Artificial Sequence
  siRNA
ggaagcuuaaagugcuuggtt

SEQ ID NO: 951 - DNA, 21 bp, Artificial Sequence
  siRNA
gcuuaaagugcuuggcucgtt

SEQ ID NO: 952 - DNA, 21 bp, Artificial Sequence
  siRNA
agugcuuggcucggguguctt

SEQ ID NO: 953 - DNA, 21 bp, Artificial Sequence
  siRNA
cugugcacaaaggagugugtt

SEQ ID NO: 954 - DNA, 21 bp, Artificial Sequence
  siRNA
aggaguguggaucccugagtt

SEQ ID NO: 955 - DNA, 21 bp, Artificial Sequence
  siRNA
ucaaucaagauuccagucutt

SEQ ID NO: 956 - DNA, 21 bp, Artificial Sequence
  siRNA
ucaagauuccagucugcautt

SEQ ID NO: 957 - DNA, 21 bp, Artificial Sequence
  siRNA
gauuccagucugcauuaaatt

SEQ ID NO: 958 - DNA, 21 bp, Artificial Sequence
  siRNA
agucauugaggacaagagutt

SEQ ID NO: 959 - DNA, 21 bp, Artificial Sequence
  siRNA
gaguggacggcagaguuuutt

SEQ ID NO: 960 - DNA, 21 bp, Artificial Sequence
  siRNA
gcugugacagaucauaugctt

SEQ ID NO: 961 - DNA, 21 bp, Artificial Sequence
  siRNA
ggcugcugggacuaugccctt

SEQ ID NO: 962 - DNA, 21 bp, Artificial Sequence
  siRNA
uauuugccucuggguucuctt

SEQ ID NO: 963 - DNA, 21 bp, Artificial Sequence
  siRNA
caccggggggcacuggggctt

SEQ ID NO: 964 - DNA, 21 bp, Artificial Sequence
  siRNA
cuggggaguacaaauugcctt

SEQ ID NO: 965 - DNA, 21 bp, Artificial Sequence
  siRNA
auugccaagggaauguacutt

SEQ ID NO: 966 - DNA, 21 bp, Artificial Sequence
  siRNA
gggaauguacuaccuugagtt

SEQ ID NO: 967 - DNA, 21 bp, Artificial Sequence
  siRNA
uguacuaccuugaggaacatt

SEQ ID NO: 968 - DNA, 21 bp, Artificial Sequence
  siRNA
caugguauggugcauagaatt

SEQ ID NO: 969 - DNA, 21 bp, Artificial Sequence
  siRNA
accuggcugcccgaaacgutt

SEQ ID NO: 970 - DNA, 21 bp, Artificial Sequence
  siRNA
acgugcuacucaagucacctt

SEQ ID NO: 971 - DNA, 21 bp, Artificial Sequence
  siRNA
gucacccagucagguucagtt

SEQ ID NO: 972 - DNA, 21 bp, Artificial Sequence
  siRNA
gcagcugcuauacagugagtt

SEQ ID NO: 973 - DNA, 21 bp, Artificial Sequence
  siRNA
gacuccaauuaaguggaugtt

SEQ ID NO: 974 - DNA, 21 bp, Artificial Sequence
  siRNA
uuaaguggauggcccuugatt

SEQ ID NO: 975 - DNA, 21 bp, Artificial Sequence
  siRNA
guggauggcccuugagagutt

SEQ ID NO: 976 - DNA, 21 bp, Artificial Sequence
  siRNA
auacacacaccagagugautt

SEQ ID NO: 977 - DNA, 21 bp, Artificial Sequence
  siRNA
guaccagaccugcuagagatt

SEQ ID NO: 978 - DNA, 21 bp, Artificial Sequence
  siRNA
gggggagcgguuggcacagtt

SEQ ID NO: 979 - DNA, 21 bp, Artificial Sequence
  siRNA
uugaugucuacauggugautt

SEQ ID NO: 980 - DNA, 21 bp, Artificial Sequence
  siRNA
guguuggaugauugaugagtt

SEQ ID NO: 981 - DNA, 21 bp, Artificial Sequence
  siRNA
cauucgcccaaccuuuaaatt

SEQ ID NO: 982 - DNA, 21 bp, Artificial Sequence
  siRNA
ccuuuaaagaacuagccaatt

SEQ ID NO: 983 - DNA, 21 bp, Artificial Sequence
  siRNA
agaacuagccaaugaguuctt

SEQ ID NO: 984 - DNA, 21 bp, Artificial Sequence
  siRNA
cuagccaaugaguucaccatt

SEQ ID NO: 985 - DNA, 21 bp, Artificial Sequence
  siRNA
ugaguucaccaggauggcctt

SEQ ID NO: 986 - DNA, 21 bp, Artificial Sequence
  siRNA
agagagagagugggccuggtt

SEQ ID NO: 987 - DNA, 21 bp, Artificial Sequence
  siRNA
uagccccugggccagagcctt

SEQ ID NO: 988 - DNA, 21 bp, Artificial Sequence
  siRNA
acaagaagcuagaggaagutt

SEQ ID NO: 989 - DNA, 21 bp, Artificial Sequence
  siRNA
gaagcuagaggaaguagagtt

SEQ ID NO: 990 - DNA, 21 bp, Artificial Sequence
  siRNA
gcuagaggaaguagagcugtt

SEQ ID NO: 991 - DNA, 21 bp, Artificial Sequence
  siRNA
guagagcuggagccagaactt

SEQ ID NO: 992 - DNA, 21 bp, Artificial Sequence
  siRNA
cuagaccuagaccuagacutt

SEQ ID NO: 993 - DNA, 21 bp, Artificial Sequence
  siRNA
gcagaggaggacaaccuggtt

SEQ ID NO: 994 - DNA, 21 bp, Artificial Sequence
  siRNA
ccuggcaaccaccacacugtt

SEQ ID NO: 995 - DNA, 21 bp, Artificial Sequence
  siRNA
ccaccacacugggcuccgctt

SEQ ID NO: 996 - DNA, 21 bp, Artificial Sequence
  siRNA
cacuuaaucggccacguggtt

SEQ ID NO: 997 - DNA, 21 bp, Artificial Sequence
  siRNA
ucggccacgugggagccagtt

SEQ ID NO: 998 - DNA, 21 bp, Artificial Sequence
  siRNA
guccaucaucuggauacautt

SEQ ID NO: 999 - DNA, 21 bp, Artificial Sequence
  siRNA
ccaggguaaucuuggggagtt

SEQ ID NO: 1000 - DNA, 21 bp, Artificial Sequence
  siRNA
ucuuggggagucuugccagtt

SEQ ID NO: 1001 - DNA, 21 bp, Artificial Sequence
  siRNA
cggugcccccguccagucutt

SEQ ID NO: 1002 - DNA, 21 bp, Artificial Sequence
  siRNA
ugccacggggaugccuggctt

SEQ ID NO: 1003 - DNA, 21 bp, Artificial Sequence
  siRNA
caggcucugaggcugagcutt

SEQ ID NO: 1004 - DNA, 21 bp, Artificial Sequence
  siRNA
agugucaauguguaggagctt

SEQ ID NO: 1005 - DNA, 21 bp, Artificial Sequence
  siRNA
uguguaggagccggagcagtt

SEQ ID NO: 1006 - DNA, 21 bp, Artificial Sequence
  siRNA
gaggaugucaacgguuaugtt

SEQ ID NO: 1007 - DNA, 21 bp, Artificial Sequence
  siRNA
cgguuaugucaugccagautt

SEQ ID NO: 1008 - DNA, 21 bp, Artificial Sequence
  siRNA
agguacucccuccucccggtt

SEQ ID NO: 1009 - DNA, 21 bp, Artificial Sequence
  siRNA
ggcacccuuucuucaguggtt

SEQ ID NO: 1010 - DNA, 21 bp, Artificial Sequence
  siRNA
gaagaagaugaagaugaggtt

SEQ ID NO: 1011 - DNA, 21 bp, Artificial Sequence
  siRNA
gaagaugaagaugaggagutt

SEQ ID NO: 1012 - DNA, 21 bp, Artificial Sequence
  siRNA
gaugaagaugaggaguaugtt

SEQ ID NO: 1013 - DNA, 21 bp, Artificial Sequence
  siRNA
gaugaggaguaugaauacatt

SEQ ID NO: 1014 - DNA, 21 bp, Artificial Sequence
  siRNA
uacaugaaccggaggagaatt

SEQ ID NO: 1015 - DNA, 21 bp, Artificial Sequence
  siRNA
ccggaggagaaggcacagutt

SEQ ID NO: 1016 - DNA, 21 bp, Artificial Sequence
  siRNA
ggcacaguccaccucaucctt

SEQ ID NO: 1017 - DNA, 21 bp, Artificial Sequence
  siRNA
guucccuugaggagcugggtt

SEQ ID NO: 1018 - DNA, 21 bp, Artificial Sequence
  siRNA
cuccagaugaagacuaugatt

SEQ ID NO: 1019 - DNA, 21 bp, Artificial Sequence
  siRNA
gacuaugaauauaugaauctt

SEQ ID NO: 1020 - DNA, 21 bp, Artificial Sequence
  siRNA
uauaugaaucggcaacgagtt

SEQ ID NO: 1021 - DNA, 21 bp, Artificial Sequence
  siRNA
ucggcaacgagauggaggutt

SEQ ID NO: 1022 - DNA, 21 bp, Artificial Sequence
  siRNA
cgagauggaggugguccugtt

SEQ ID NO: 1023 - DNA, 21 bp, Artificial Sequence
  siRNA
ggguaugaagagaugagagtt

SEQ ID NO: 1024 - DNA, 21 bp, Artificial Sequence
  siRNA
gagaugagagcuuuucaggtt

SEQ ID NO: 1025 - DNA, 21 bp, Artificial Sequence
  siRNA
aaacucuacguagcuuagatt

SEQ ID NO: 1026 - DNA, 21 bp, Artificial Sequence
  siRNA
acucuacguagcuuagaggtt

SEQ ID NO: 1027 - DNA, 21 bp, Artificial Sequence
  siRNA
cccugauuacuggcauagctt

SEQ ID NO: 1028 - DNA, 21 bp, Artificial Sequence
  siRNA
ggcuaaugcccagagaacgtt

SEQ ID NO: 1029 - DNA, 21 bp, Artificial Sequence
  siRNA
ugcccagagaacguaacuctt

SEQ ID NO: 1030 - DNA, 21 bp, Artificial Sequence
  siRNA
cguaacuccugcucccugutt

SEQ ID NO: 1031 - DNA, 21 bp, Artificial Sequence
  siRNA
cuccugcucccuguggcactt

SEQ ID NO: 1032 - DNA, 21 bp, Artificial Sequence
  siRNA
uggcagcuagugccuuuagtt

SEQ ID NO: 1033 - DNA, 21 bp, Artificial Sequence
  siRNA
uuccauucaaucuuuggagtt

SEQ ID NO: 1034 - DNA, 21 bp, Artificial Sequence
  siRNA
ucuuuggaggcuuuuaaactt

SEQ ID NO: 1035 - DNA, 21 bp, Artificial Sequence
  siRNA
acauuuugacacaaaauuctt

SEQ ID NO: 1036 - DNA, 21 bp, Artificial Sequence
  siRNA
aauucuuaugguauguagctt

SEQ ID NO: 1037 - DNA, 21 bp, Artificial Sequence
  siRNA
uucuuaugguauguagccatt

SEQ ID NO: 1038 - DNA, 21 bp, Artificial Sequence
  siRNA
ccccaggaaagguuuuccutt

SEQ ID NO: 1039 - DNA, 21 bp, Artificial Sequence
  siRNA
agguuuuccuuauuuugugtt

SEQ ID NO: 1040 - DNA, 21 bp, Artificial Sequence
  siRNA
ggauuacucuccauauccctt

SEQ ID NO: 1041 - DNA, 21 bp, Artificial Sequence
  siRNA
cuaggcucuuaugugugcctt

SEQ ID NO: 1042 - DNA, 21 bp, Artificial Sequence
  siRNA
gaagaggaaagggaggaaatt

SEQ ID NO: 1043 - DNA, 21 bp, Artificial Sequence
  siRNA
gaggaaagggaggaaaccutt

SEQ ID NO: 1044 - DNA, 21 bp, Artificial Sequence
  siRNA
agggaggaaaccuagcagatt

SEQ ID NO: 1045 - DNA, 21 bp, Artificial Sequence
  siRNA
accuagcagaggaaagugutt

SEQ ID NO: 1046 - DNA, 21 bp, Artificial Sequence
  siRNA
aguguaauuuugguuuaugtt

SEQ ID NO: 1047 - DNA, 21 bp, Artificial Sequence
  siRNA
uuuugguuuaugacucuuatt

SEQ ID NO: 1048 - DNA, 21 bp, Artificial Sequence
  siRNA
cccccuagaaagacagaagtt

SEQ ID NO: 1049 - DNA, 21 bp, Artificial Sequence
  siRNA
agacagaagcuuaaaaucutt

SEQ ID NO: 1050 - DNA, 21 bp, Artificial Sequence
  siRNA
gcuuaaaaucugugaagaatt

SEQ ID NO: 1051 - DNA, 21 bp, Artificial Sequence
  siRNA
aaucugugaagaaagaggutt

SEQ ID NO: 1052 - DNA, 21 bp, Artificial Sequence
  siRNA
ucugugaagaaagagguuatt

SEQ ID NO: 1053 - DNA, 21 bp, Artificial Sequence
  siRNA
gaaagagguuaggaguagatt

SEQ ID NO: 1054 - DNA, 21 bp, Artificial Sequence
  siRNA
agagguuaggaguagauautt

SEQ ID NO: 1055 - DNA, 21 bp, Artificial Sequence
  siRNA
uucagcacuuaacuaugagtt

SEQ ID NO: 1056 - DNA, 21 bp, Artificial Sequence
  siRNA
cuaugagccaggcaucauatt

SEQ ID NO: 1057 - DNA, 21 bp, Artificial Sequence
  siRNA
acuucaccuacauuaucuctt

SEQ ID NO: 1058 - DNA, 21 bp, Artificial Sequence
  siRNA
aacaauucugugacauacatt

SEQ ID NO: 1059 - DNA, 21 bp, Artificial Sequence
  siRNA
caauucugugacauacauatt

SEQ ID NO: 1060 - DNA, 21 bp, Artificial Sequence
  siRNA
uucugugacauacauauuatt

SEQ ID NO: 1061 - DNA, 21 bp, Artificial Sequence
  siRNA
agggaagucgggcauggugtt

SEQ ID NO: 1062 - DNA, 21 bp, Artificial Sequence
  siRNA
gucgggcaugguggcucautt

SEQ ID NO: 1063 - DNA, 21 bp, Artificial Sequence
  siRNA
ucucagcacuuugggaggctt

SEQ ID NO: 1064 - DNA, 21 bp, Artificial Sequence
  siRNA
ggauuaccugaggcaaggatt

SEQ ID NO: 1065 - DNA, 21 bp, Artificial Sequence
  siRNA
ggaguuugagaccagcuuatt

SEQ ID NO: 1066 - DNA, 21 bp, Artificial Sequence
  siRNA
cauaguaagacccccaucutt

SEQ ID NO: 1067 - DNA, 21 bp, Artificial Sequence
  siRNA
gacccccaucucuuuaaaatt

SEQ ID NO: 1068 - DNA, 21 bp, Artificial Sequence
  siRNA
aaaaaaaaaaaaaaaaaaatt

SEQ ID NO: 1069 - DNA, 21 bp, Artificial Sequence
  siRNA
aaaaaaaaaaaaaaaaaactt

SEQ ID NO: 1070 - DNA, 21 bp, Artificial Sequence
  siRNA
aaaaaaaaaaaaaaaacuutt

SEQ ID NO: 1071 - DNA, 21 bp, Artificial Sequence
  siRNA
aaaaaaaaaaaaaacuuuatt

SEQ ID NO: 1072 - DNA, 21 bp, Artificial Sequence
  siRNA
aaaaaaaaaaaacuuuagatt

SEQ ID NO: 1073 - DNA, 21 bp, Artificial Sequence
  siRNA
aaaaaaaaaacuuuagaactt

SEQ ID NO: 1074 - DNA, 21 bp, Artificial Sequence
  siRNA
aaaaaaaacuuuagaacugtt

SEQ ID NO: 1075 - DNA, 21 bp, Artificial Sequence
  siRNA
aaaaaacuuuagaacugggtt

SEQ ID NO: 1076 - DNA, 21 bp, Artificial Sequence
  siRNA
aaaacuuuagaacugggugtt

SEQ ID NO: 1077 - DNA, 21 bp, Artificial Sequence
  siRNA
aacuuuagaacugggugcatt

SEQ ID NO: 1078 - DNA, 21 bp, Artificial Sequence
  siRNA
cuuuagaacugggugcagutt

SEQ ID NO: 1079 - DNA, 21 bp, Artificial Sequence
  siRNA
cugggugcaguggcucaugtt

SEQ ID NO: 1080 - DNA, 21 bp, Artificial Sequence
  siRNA
ucccagccagcacuuugggtt

SEQ ID NO: 1081 - DNA, 21 bp, Artificial Sequence
  siRNA
gaucacuugagcccagaautt

SEQ ID NO: 1082 - DNA, 21 bp, Artificial Sequence
  siRNA
uuagagauaagccuauggatt

SEQ ID NO: 1083 - DNA, 21 bp, Artificial Sequence
  siRNA
gccuauggaaacauagcaatt

SEQ ID NO: 1084 - DNA, 21 bp, Artificial Sequence
  siRNA
acauagcaagacacugucutt

SEQ ID NO: 1085 - DNA, 21 bp, Artificial Sequence
  siRNA
gacacugucucuacaggggtt

SEQ ID NO: 1086 - DNA, 21 bp, Artificial Sequence
  siRNA
aaaaaaaaaagaaacugagtt

SEQ ID NO: 1087 - DNA, 21 bp, Artificial Sequence
  siRNA
aaaaaaaagaaacugagcctt

SEQ ID NO: 1088 - DNA, 21 bp, Artificial Sequence
  siRNA
aaaaaagaaacugagccuutt

SEQ ID NO: 1089 - DNA, 21 bp, Artificial Sequence
  siRNA
aaaagaaacugagccuuaatt

SEQ ID NO: 1090 - DNA, 21 bp, Artificial Sequence
  siRNA
aagaaacugagccuuaaagtt

SEQ ID NO: 1091 - DNA, 21 bp, Artificial Sequence
  siRNA
gaaacugagccuuaaagagtt

SEQ ID NO: 1092 - DNA, 21 bp, Artificial Sequence
  siRNA
acugagccuuaaagagaugtt

SEQ ID NO: 1093 - DNA, 21 bp, Artificial Sequence
  siRNA
agagaugaaauaaauuaagtt

SEQ ID NO: 1094 - DNA, 21 bp, Artificial Sequence
  siRNA
auaaauuaagcaguagauctt

SEQ ID NO: 1095 - DNA, 21 bp, Artificial Sequence
  siRNA
auuaagcaguagauccaggtt

SEQ ID NO: 1096 - DNA, 21 bp, Artificial Sequence
  siRNA
gcaguagauccaggaugcatt

SEQ ID NO: 1097 - DNA, 21 bp, Artificial Sequence
  siRNA
aauccucccaauuccugugtt

SEQ ID NO: 1098 - DNA, 21 bp, Artificial Sequence
  siRNA
uccucccaauuccugugcatt

SEQ ID NO: 1099 - DNA, 21 bp, Artificial Sequence
  siRNA
uuccugugcaugugcucuutt

SEQ ID NO: 1100 - DNA, 21 bp, Artificial Sequence
  siRNA
ggugccaagaaaaacugautt

SEQ ID NO: 1101 - DNA, 21 bp, Artificial Sequence
  siRNA
gaaaaacugauuuaaguuatt

SEQ ID NO: 1102 - DNA, 21 bp, Artificial Sequence
  siRNA
aaacugauuuaaguuacagtt

SEQ ID NO: 1103 - DNA, 21 bp, Artificial Sequence
  siRNA
acugauuuaaguuacagcctt

SEQ ID NO: 1104 - DNA, 21 bp, Artificial Sequence
  siRNA
guuacagcccuuguuuaagtt

SEQ ID NO: 1105 - DNA, 21 bp, Artificial Sequence
  siRNA
ggggcacuguuucuuguuutt

SEQ ID NO: 1106 - DNA, 21 bp, Artificial Sequence
  siRNA
ucaagucuaaccccaacagtt

SEQ ID NO: 1107 - DNA, 21 bp, Artificial Sequence
  siRNA
gucuaaccccaacagccactt

SEQ ID NO: 1108 - DNA, 21 bp, Artificial Sequence
  siRNA
ccccaacagccacauccuctt

SEQ ID NO: 1109 - DNA, 21 bp, Artificial Sequence
  siRNA
cagccacauccuccuauactt

SEQ ID NO: 1110 - DNA, 21 bp, Artificial Sequence
  siRNA
guggugguggggguagucatt

SEQ ID NO: 1111 - DNA, 21 bp, Artificial Sequence
  siRNA
ggaaaaauaacuggacauctt

SEQ ID NO: 1112 - DNA, 21 bp, Artificial Sequence
  siRNA
aaauaacuggacaucuuugtt

SEQ ID NO: 1113 - DNA, 21 bp, Artificial Sequence
  siRNA
auaacuggacaucuuugugtt

SEQ ID NO: 1114 - DNA, 21 bp, Artificial Sequence
  siRNA
cuggacaucuuuguguaaatt

SEQ ID NO: 1115 - DNA, 21 bp, Artificial Sequence
  siRNA
accauaauccacaugugcctt

SEQ ID NO: 1116 - DNA, 21 bp, Artificial Sequence
  siRNA
uccacaugugccguaaaugtt

SEQ ID NO: 1117 - DNA, 21 bp, Artificial Sequence
  siRNA
augaucuucacuccuuauctt

SEQ ID NO: 1118 - DNA, 21 bp, Artificial Sequence
  siRNA
auucacaaggauccccaagtt

SEQ ID NO: 1119 - DNA, 21 bp, Artificial Sequence
  siRNA
ggauccccaagauccacuutt

SEQ ID NO: 1120 - DNA, 21 bp, Artificial Sequence
  siRNA
gauccacuuuuagaagccatt

SEQ ID NO: 1121 - DNA, 21 bp, Artificial Sequence
  siRNA
ggcccaggacacggacagctt

SEQ ID NO: 1122 - DNA, 21 bp, Artificial Sequence
  siRNA
gagggaaaggcagaugcugtt

SEQ ID NO: 1123 - DNA, 21 bp, Artificial Sequence
  siRNA
cuaggcuacagcaucccuutt

SEQ ID NO: 1124 - DNA, 21 bp, Artificial Sequence
  siRNA
ugcuaggcuacagcauccctt

SEQ ID NO: 1125 - DNA, 21 bp, Artificial Sequence
  siRNA
agagcacgcuuggaugugctt

SEQ ID NO: 1126 - DNA, 21 bp, Artificial Sequence
  siRNA
aggagaggggagagcacgctt

SEQ ID NO: 1127 - DNA, 21 bp, Artificial Sequence
  siRNA
agcccaggguguaugugugtt

SEQ ID NO: 1128 - DNA, 21 bp, Artificial Sequence
  siRNA
ugaggggaaccgccgucautt

SEQ ID NO: 1129 - DNA, 21 bp, Artificial Sequence
  siRNA
accuuccaggaagcguggatt

SEQ ID NO: 1130 - DNA, 21 bp, Artificial Sequence
  siRNA
gugagcccagccacucacctt

SEQ ID NO: 1131 - DNA, 21 bp, Artificial Sequence
  siRNA
ugcgaacgcggccgccgcctt

SEQ ID NO: 1132 - DNA, 21 bp, Artificial Sequence
  siRNA
ucuccagauuauccuuccctt

SEQ ID NO: 1133 - DNA, 21 bp, Artificial Sequence
  siRNA
aucccucuccagauuaucctt

SEQ ID NO: 1134 - DNA, 21 bp, Artificial Sequence
  siRNA
ugagggaucccucuccagatt

SEQ ID NO: 1135 - DNA, 21 bp, Artificial Sequence
  siRNA
uuauaaaaugguuggaguctt

SEQ ID NO: 1136 - DNA, 21 bp, Artificial Sequence
  siRNA
agauuccauuauaaaauggtt

SEQ ID NO: 1137 - DNA, 21 bp, Artificial Sequence
  siRNA
ucacaaaauaaagauuccatt

SEQ ID NO: 1138 - DNA, 21 bp, Artificial Sequence
  siRNA
uacuuucacaaaauaaagatt

SEQ ID NO: 1139 - DNA, 21 bp, Artificial Sequence
  siRNA
gagaugaguccccgcuacutt

SEQ ID NO: 1140 - DNA, 21 bp, Artificial Sequence
  siRNA
uggggccccgaggaacucctt

SEQ ID NO: 1141 - DNA, 21 bp, Artificial Sequence
  siRNA
aggagaagagugcuggcugtt

SEQ ID NO: 1142 - DNA, 21 bp, Artificial Sequence
  siRNA
caucuccaccuugauggagtt

SEQ ID NO: 1143 - DNA, 21 bp, Artificial Sequence
  siRNA
aucgcuguacaucuccacctt

SEQ ID NO: 1144 - DNA, 21 bp, Artificial Sequence
  siRNA
ucuggccccagcagucugctt

SEQ ID NO: 1145 - DNA, 21 bp, Artificial Sequence
  siRNA
caaucacgcugucguccuutt

SEQ ID NO: 1146 - DNA, 21 bp, Artificial Sequence
  siRNA
cacaaucacgcugucgucctt

SEQ ID NO: 1147 - DNA, 21 bp, Artificial Sequence
  siRNA
ggggcucagacaaugaauctt

SEQ ID NO: 1148 - DNA, 21 bp, Artificial Sequence
  siRNA
gucacacuugagcuugccatt

SEQ ID NO: 1149 - DNA, 21 bp, Artificial Sequence
  siRNA
gcagacgucacacuugagctt

SEQ ID NO: 1150 - DNA, 21 bp, Artificial Sequence
  siRNA
caugccgcagacgucacactt

SEQ ID NO: 1151 - DNA, 21 bp, Artificial Sequence
  siRNA
cuugugcaccaugagcacgtt

SEQ ID NO: 1152 - DNA, 21 bp, Artificial Sequence
  siRNA
uucaccagugugacugcgctt

SEQ ID NO: 1153 - DNA, 21 bp, Artificial Sequence
  siRNA
gguugcaauggaagggccutt

SEQ ID NO: 1154 - DNA, 21 bp, Artificial Sequence
  siRNA
gaaggaggcaccacacuggtt

SEQ ID NO: 1155 - DNA, 21 bp, Artificial Sequence
  siRNA
guggcgcagcagguucccctt

SEQ ID NO: 1156 - DNA, 21 bp, Artificial Sequence
  siRNA
cuugauguggcgcagcaggtt

SEQ ID NO: 1157 - DNA, 21 bp, Artificial Sequence
  siRNA
cuucuccccagagugcagctt

SEQ ID NO: 1158 - DNA, 21 bp, Artificial Sequence
  siRNA
gaagggacauuuaaagggctt

SEQ ID NO: 1159 - DNA, 21 bp, Artificial Sequence
  siRNA
auaguugcagaagggacautt

SEQ ID NO: 1160 - DNA, 21 bp, Artificial Sequence
  siRNA
acgccggcggcaggcauagtt

SEQ ID NO: 1161 - DNA, 21 bp, Artificial Sequence
  siRNA
guaguuacacuuguagggctt

SEQ ID NO: 1162 - DNA, 21 bp, Artificial Sequence
  siRNA
ccggccacaguaguuacactt

SEQ ID NO: 1163 - DNA, 21 bp, Artificial Sequence
  siRNA
guagcuccggccacaguagtt

SEQ ID NO: 1164 - DNA, 21 bp, Artificial Sequence
  siRNA
cuccaggguacucugcugutt

SEQ ID NO: 1165 - DNA, 21 bp, Artificial Sequence
  siRNA
guaguuauggcaccgcucctt

SEQ ID NO: 1166 - DNA, 21 bp, Artificial Sequence
  siRNA
gcugagacucuguagguagtt

SEQ ID NO: 1167 - DNA, 21 bp, Artificial Sequence
  siRNA
ggccagccaaagcuugggctt

SEQ ID NO: 1168 - DNA, 21 bp, Artificial Sequence
  siRNA
cugguuggccagccaaagctt

SEQ ID NO: 1169 - DNA, 21 bp, Artificial Sequence
  siRNA
cacguauuucgucaccuggtt

SEQ ID NO: 1170 - DNA, 21 bp, Artificial Sequence
  siRNA
ccaucuccaggucacguautt

SEQ ID NO: 1171 - DNA, 21 bp, Artificial Sequence
  siRNA
gccagacgaucgaugaaagtt

SEQ ID NO: 1172 - DNA, 21 bp, Artificial Sequence
  siRNA
cuugcguuuggugaggcuatt

SEQ ID NO: 1173 - DNA, 21 bp, Artificial Sequence
  siRNA
ggguguggaacgcuugcgutt

SEQ ID NO: 1174 - DNA, 21 bp, Artificial Sequence
  siRNA
cuucugggguguggaacgctt

SEQ ID NO: 1175 - DNA, 21 bp, Artificial Sequence
  siRNA
cugcuuuucgccuacaaactt

SEQ ID NO: 1176 - DNA, 21 bp, Artificial Sequence
  siRNA
ggcugaagcgcaucugcuutt

SEQ ID NO: 1177 - DNA, 21 bp, Artificial Sequence
  siRNA
gaggcugaagcgcaucugctt

SEQ ID NO: 1178 - DNA, 21 bp, Artificial Sequence
  siRNA
cuuuucauagccacccgagtt

SEQ ID NO: 1179 - DNA, 21 bp, Artificial Sequence
  siRNA
ccaccaacuccacauccuutt

SEQ ID NO: 1180 - DNA, 21 bp, Artificial Sequence
  siRNA
ugccaccaacuccacaucctt

SEQ ID NO: 1181 - DNA, 21 bp, Artificial Sequence
  siRNA
cccacaaaggccagggaactt

SEQ ID NO: 1182 - DNA, 21 bp, Artificial Sequence
  siRNA
cgugaguucugagaugcaatt

SEQ ID NO: 1183 - DNA, 21 bp, Artificial Sequence
  siRNA
agcugaugacaggcgugagtt

SEQ ID NO: 1184 - DNA, 21 bp, Artificial Sequence
  siRNA
ccucaggucccucaccugctt

SEQ ID NO: 1185 - DNA, 21 bp, Artificial Sequence
  siRNA
uguggaguccuggcagccatt

SEQ ID NO: 1186 - DNA, 21 bp, Artificial Sequence
  siRNA
cccgaucuucgugguugcutt

SEQ ID NO: 1187 - DNA, 21 bp, Artificial Sequence
  siRNA
cgcaacccgaucuucguggtt

SEQ ID NO: 1188 - DNA, 21 bp, Artificial Sequence
  siRNA
ccacccccgcaacccgauctt

SEQ ID NO: 1189 - DNA, 21 bp, Artificial Sequence
  siRNA
cuguggcuugggguccucutt

SEQ ID NO: 1190 - DNA, 21 bp, Artificial Sequence
  siRNA
caauaaccccuccuguggctt

SEQ ID NO: 1191 - DNA, 21 bp, Artificial Sequence
  siRNA
caccacccgaagcacuucctt

SEQ ID NO: 1192 - DNA, 21 bp, Artificial Sequence
  siRNA
cgcccaccacccgaagcactt

SEQ ID NO: 1193 - DNA, 21 bp, Artificial Sequence
  siRNA
gugcucacacuugaaggcctt

SEQ ID NO: 1194 - DNA, 21 bp, Artificial Sequence
  siRNA
gauacggcagugcucacactt

SEQ ID NO: 1195 - DNA, 21 bp, Artificial Sequence
  siRNA
gcugugauaaccacagaugtt

SEQ ID NO: 1196 - DNA, 21 bp, Artificial Sequence
  siRNA
ggacaaugugggaagagaatt

SEQ ID NO: 1197 - DNA, 21 bp, Artificial Sequence
  siRNA
gagagguugcuagcccacctt

SEQ ID NO: 1198 - DNA, 21 bp, Artificial Sequence
  siRNA
cugaggagagagggagaggtt

SEQ ID NO: 1199 - DNA, 21 bp, Artificial Sequence
  siRNA
ggcuacaaagcaaaacucctt

SEQ ID NO: 1200 - DNA, 21 bp, Artificial Sequence
  siRNA
aucuguuucaucacaaugctt

SEQ ID NO: 1201 - DNA, 21 bp, Artificial Sequence
  siRNA
acauaagcaaaagaucugutt

SEQ ID NO: 1202 - DNA, 21 bp, Artificial Sequence
  siRNA
gcaaaaauaaaucaacuaatt

SEQ ID NO: 1203 - DNA, 21 bp, Artificial Sequence
  siRNA
gacugauauaaguuaaaautt

SEQ ID NO: 1204 - DNA, 21 bp, Artificial Sequence
  siRNA
ggcaagugacugauauaagtt

SEQ ID NO: 1205 - DNA, 21 bp, Artificial Sequence
  siRNA
ggccuaaaguggaaaggagtt

SEQ ID NO: 1206 - DNA, 21 bp, Artificial Sequence
  siRNA
aagaucuaagagagaaaaatt

SEQ ID NO: 1207 - DNA, 21 bp, Artificial Sequence
  siRNA
ucuuaguacuaagaggagctt

SEQ ID NO: 1208 - DNA, 21 bp, Artificial Sequence
  siRNA
gcaagaagcuugaagucuctt

SEQ ID NO: 1209 - DNA, 21 bp, Artificial Sequence
  siRNA
aggacuuaaagcaagaagctt

SEQ ID NO: 1210 - DNA, 21 bp, Artificial Sequence
  siRNA
uaauguaaagggugaggactt

SEQ ID NO: 1211 - DNA, 21 bp, Artificial Sequence
  siRNA
cagcaucaaaacugaagaatt

SEQ ID NO: 1212 - DNA, 21 bp, Artificial Sequence
  siRNA
agagguauggaguaccaggtt

SEQ ID NO: 1213 - DNA, 21 bp, Artificial Sequence
  siRNA
ggaaauaauucuucauucatt

SEQ ID NO: 1214 - DNA, 21 bp, Artificial Sequence
  siRNA
augaggaaauaauucuucatt

SEQ ID NO: 1215 - DNA, 21 bp, Artificial Sequence
  siRNA
ccaaaugaggaaauaauuctt

SEQ ID NO: 1216 - DNA, 21 bp, Artificial Sequence
  siRNA
cuuccaaaugaggaaauaatt

SEQ ID NO: 1217 - DNA, 21 bp, Artificial Sequence
  siRNA
uuucuucagucccuccuactt

SEQ ID NO: 1218 - DNA, 21 bp, Artificial Sequence
  siRNA
agugccuggggagaauuuctt

SEQ ID NO: 1219 - DNA, 21 bp, Artificial Sequence
  siRNA
cacagugccuggggagaautt

SEQ ID NO: 1220 - DNA, 21 bp, Artificial Sequence
  siRNA
acuaggggaauaugaccuatt

SEQ ID NO: 1221 - DNA, 21 bp, Artificial Sequence
  siRNA
uaggcuuugagaacucauatt

SEQ ID NO: 1222 - DNA, 21 bp, Artificial Sequence
  siRNA
gagauccugaauguaggcutt

SEQ ID NO: 1223 - DNA, 21 bp, Artificial Sequence
  siRNA
agagcguguggagggguagtt

SEQ ID NO: 1224 - DNA, 21 bp, Artificial Sequence
  siRNA
cacuuaauagaccgguaggtt

SEQ ID NO: 1225 - DNA, 21 bp, Artificial Sequence
  siRNA
aggagagaaaagccaccactt

SEQ ID NO: 1226 - DNA, 21 bp, Artificial Sequence
  siRNA
ggccccugagaauauaaaatt

SEQ ID NO: 1227 - DNA, 21 bp, Artificial Sequence
  siRNA
gaggguugcagaccuagcctt

SEQ ID NO: 1228 - DNA, 21 bp, Artificial Sequence
  siRNA
aucugucagagacagagggtt

SEQ ID NO: 1229 - DNA, 21 bp, Artificial Sequence
  siRNA
cccaugcccugguucccaatt

SEQ ID NO: 1230 - DNA, 21 bp, Artificial Sequence
  siRNA
cuccuuucccaugcccuggtt

SEQ ID NO: 1231 - DNA, 21 bp, Artificial Sequence
  siRNA
agaauuuugacccacuccutt

SEQ ID NO: 1232 - DNA, 21 bp, Artificial Sequence
  siRNA
gaggagaaagagaagaauutt

SEQ ID NO: 1233 - DNA, 21 bp, Artificial Sequence
  siRNA
uggaggagaaagagaagaatt

SEQ ID NO: 1234 - DNA, 21 bp, Artificial Sequence
  siRNA
gucacuauagugaagaagutt

SEQ ID NO: 1235 - DNA, 21 bp, Artificial Sequence
  siRNA
caggcagcaacccacuagutt

SEQ ID NO: 1236 - DNA, 21 bp, Artificial Sequence
  siRNA
gaggggcugaaacaacccctt

SEQ ID NO: 1237 - DNA, 21 bp, Artificial Sequence
  siRNA
agagaaaagagauacccgutt

SEQ ID NO: 1238 - DNA, 21 bp, Artificial Sequence
  siRNA
uuuuugguuauacugaaaatt

SEQ ID NO: 1239 - DNA, 21 bp, Artificial Sequence
  siRNA
augcugggauaauuuuuggtt

SEQ ID NO: 1240 - DNA, 21 bp, Artificial Sequence
  siRNA
gcucaugcugggauaauuutt

SEQ ID NO: 1241 - DNA, 21 bp, Artificial Sequence
  siRNA
gugcucaugcugggauaautt

SEQ ID NO: 1242 - DNA, 21 bp, Artificial Sequence
  siRNA
aguuguacccaucccaguctt

SEQ ID NO: 1243 - DNA, 21 bp, Artificial Sequence
  siRNA
aaggaagaccccaguucagtt

SEQ ID NO: 1244 - DNA, 21 bp, Artificial Sequence
  siRNA
uaguaaaggaagaccccagtt

SEQ ID NO: 1245 - DNA, 21 bp, Artificial Sequence
  siRNA
ccuucucacuaauccuaggtt

SEQ ID NO: 1246 - DNA, 21 bp, Artificial Sequence
  siRNA
uuguaucuccuucugcccctt

SEQ ID NO: 1247 - DNA, 21 bp, Artificial Sequence
  siRNA
gcaguggaguuguaucucctt

SEQ ID NO: 1248 - DNA, 21 bp, Artificial Sequence
  siRNA
accuccacuugcaguggagtt

SEQ ID NO: 1249 - DNA, 21 bp, Artificial Sequence
  siRNA
uguagaaagaaaccuccactt

SEQ ID NO: 1250 - DNA, 21 bp, Artificial Sequence
  siRNA
ggccuugggcagaaaacuctt

SEQ ID NO: 1251 - DNA, 21 bp, Artificial Sequence
  siRNA
gagugggauggcuguggcctt

SEQ ID NO: 1252 - DNA, 21 bp, Artificial Sequence
  siRNA
uagaaaaacagccuuuggutt

SEQ ID NO: 1253 - DNA, 21 bp, Artificial Sequence
  siRNA
aaacauagaaaaacagccutt

SEQ ID NO: 1254 - DNA, 21 bp, Artificial Sequence
  siRNA
uuuuuacuuuuuuuuuucutt

SEQ ID NO: 1255 - DNA, 21 bp, Artificial Sequence
  siRNA
uugguuuuuacuuuuuuuutt

SEQ ID NO: 1256 - DNA, 21 bp, Artificial Sequence
  siRNA
guuugguuuuuacuuuuuutt

SEQ ID NO: 1257 - DNA, 21 bp, Artificial Sequence
  siRNA
guguuugguuuuuacuuuutt

SEQ ID NO: 1258 - DNA, 21 bp, Artificial Sequence
  siRNA
uuguguuugguuuuuacuutt

SEQ ID NO: 1259 - DNA, 21 bp, Artificial Sequence
  siRNA
uguuguguuugguuuuuactt

SEQ ID NO: 1260 - DNA, 21 bp, Artificial Sequence
  siRNA
gagguguuguguuugguuutt

SEQ ID NO: 1261 - DNA, 21 bp, Artificial Sequence
  siRNA
gugagguguuguguuuggutt

SEQ ID NO: 1262 - DNA, 21 bp, Artificial Sequence
  siRNA
aacuugugagguguugugutt

SEQ ID NO: 1263 - DNA, 21 bp, Artificial Sequence
  siRNA
aguuacaacuugugaggugtt

SEQ ID NO: 1264 - DNA, 21 bp, Artificial Sequence
  siRNA
aaggaccaagaguuacaactt

SEQ ID NO: 1265 - DNA, 21 bp, Artificial Sequence
  siRNA
gagagagaaggaccaagagtt

SEQ ID NO: 1266 - DNA, 21 bp, Artificial Sequence
  siRNA
cuguuccuuagcccacccutt

SEQ ID NO: 1267 - DNA, 21 bp, Artificial Sequence
  siRNA
uaaucccagggucuguucctt

SEQ ID NO: 1268 - DNA, 21 bp, Artificial Sequence
  siRNA
gcccuaaucccagggucugtt

SEQ ID NO: 1269 - DNA, 21 bp, Artificial Sequence
  siRNA
uagacuccucucagagccctt

SEQ ID NO: 1270 - DNA, 21 bp, Artificial Sequence
  siRNA
aaguuuuuuagggucuccctt

SEQ ID NO: 1271 - DNA, 21 bp, Artificial Sequence
  siRNA
acaaagaggagaaaguuuutt

SEQ ID NO: 1272 - DNA, 21 bp, Artificial Sequence
  siRNA
ggacaaagaggagaaaguutt

SEQ ID NO: 1273 - DNA, 21 bp, Artificial Sequence
  siRNA
gaggacaaagaggagaaagtt

SEQ ID NO: 1274 - DNA, 21 bp, Artificial Sequence
  siRNA
cccugccaaucugguucuctt

SEQ ID NO: 1275 - DNA, 21 bp, Artificial Sequence
  siRNA
cuucucccugccaaucuggtt

SEQ ID NO: 1276 - DNA, 21 bp, Artificial Sequence
  siRNA
aacaauugccccacaaugctt

SEQ ID NO: 1277 - DNA, 21 bp, Artificial Sequence
  siRNA
cauugucaaggaggaacaatt

SEQ ID NO: 1278 - DNA, 21 bp, Artificial Sequence
  siRNA
gcaucuauuuauugcuacatt

SEQ ID NO: 1279 - DNA, 21 bp, Artificial Sequence
  siRNA
ccuuggcagcaucuauuuatt

SEQ ID NO: 1280 - DNA, 21 bp, Artificial Sequence
  siRNA
ugcccuuggcagcaucuautt

SEQ ID NO: 1281 - DNA, 21 bp, Artificial Sequence
  siRNA
accuccccauuuucugccctt

SEQ ID NO: 1282 - DNA, 21 bp, Artificial Sequence
  siRNA
cugagcuaaccuccccauutt

SEQ ID NO: 1283 - DNA, 21 bp, Artificial Sequence
  siRNA
cucugagcuaaccuccccatt

SEQ ID NO: 1284 - DNA, 21 bp, Artificial Sequence
  siRNA
gccguugaggauucuuccutt

SEQ ID NO: 1285 - DNA, 21 bp, Artificial Sequence
  siRNA
agggugccguugaggauuctt

SEQ ID NO: 1286 - DNA, 21 bp, Artificial Sequence
  siRNA
cccagggugccguugaggatt

SEQ ID NO: 1287 - DNA, 21 bp, Artificial Sequence
  siRNA
cuagcaccccagggugccgtt

SEQ ID NO: 1288 - DNA, 21 bp, Artificial Sequence
  siRNA
aaucucagcucugcugacatt

SEQ ID NO: 1289 - DNA, 21 bp, Artificial Sequence
  siRNA
uucaggaaaagcccagauatt

SEQ ID NO: 1290 - DNA, 21 bp, Artificial Sequence
  siRNA
ggcucaauaaccagaauagtt

SEQ ID NO: 1291 - DNA, 21 bp, Artificial Sequence
  siRNA
ccccagaagggacuagucctt

SEQ ID NO: 1292 - DNA, 21 bp, Artificial Sequence
  siRNA
gagguuacaggugccacagtt

SEQ ID NO: 1293 - DNA, 21 bp, Artificial Sequence
  siRNA
uccuucauguuccgggaggtt

SEQ ID NO: 1294 - DNA, 21 bp, Artificial Sequence
  siRNA
cagagcauaguccuucaugtt

SEQ ID NO: 1295 - DNA, 21 bp, Artificial Sequence
  siRNA
uagccucagagcauagucctt

SEQ ID NO: 1296 - DNA, 21 bp, Artificial Sequence
  siRNA
uuagcaccuggucuugccctt

SEQ ID NO: 1297 - DNA, 21 bp, Artificial Sequence
  siRNA
cccuccuuagcaccugguctt

SEQ ID NO: 1298 - DNA, 21 bp, Artificial Sequence
  siRNA
gaugcccccucuccccucctt

SEQ ID NO: 1299 - DNA, 21 bp, Artificial Sequence
  siRNA
uuuguaccuaagacccuggtt

SEQ ID NO: 1300 - DNA, 21 bp, Artificial Sequence
  siRNA
ggcucugaaaaguaggauutt

SEQ ID NO: 1301 - DNA, 21 bp, Artificial Sequence
  siRNA
aaggcucugaaaaguaggatt

SEQ ID NO: 1302 - DNA, 21 bp, Artificial Sequence
  siRNA
agcaugaggauguuugaggtt

SEQ ID NO: 1303 - DNA, 21 bp, Artificial Sequence
  siRNA
ggagagagcaugaggaugutt

SEQ ID NO: 1304 - DNA, 21 bp, Artificial Sequence
  siRNA
uuuuucuuuacuuuuuuuutt

SEQ ID NO: 1305 - DNA, 21 bp, Artificial Sequence
  siRNA
ucuuuuucuuuacuuuuuutt

SEQ ID NO: 1306 - DNA, 21 bp, Artificial Sequence
  siRNA
uuucuuuuucuuuacuuuutt

SEQ ID NO: 1307 - DNA, 21 bp, Artificial Sequence
  siRNA
uuuuucuuuuucuuuacuutt

SEQ ID NO: 1308 - DNA, 21 bp, Artificial Sequence
  siRNA
uuuuuuucuuuuucuuuactt

SEQ ID NO: 1309 - DNA, 21 bp, Artificial Sequence
  siRNA
uauuuuuuuuucuuuuucutt

SEQ ID NO: 1310 - DNA, 21 bp, Artificial Sequence
  siRNA
uguguauuuuuuuuucuuutt

SEQ ID NO: 1311 - DNA, 21 bp, Artificial Sequence
  siRNA
uguguguauuuuuuuuucutt

SEQ ID NO: 1312 - DNA, 21 bp, Artificial Sequence
  siRNA
aguguguguguauuuuuuutt

SEQ ID NO: 1313 - DNA, 21 bp, Artificial Sequence
  siRNA
ucaguguguguguauuuuutt

SEQ ID NO: 1314 - DNA, 21 bp, Artificial Sequence
  siRNA
uuucaguguguguguauuutt

SEQ ID NO: 1315 - DNA, 21 bp, Artificial Sequence
  siRNA
gguuucaguguguguguautt

SEQ ID NO: 1316 - DNA, 21 bp, Artificial Sequence
  siRNA
cucuuuucuccaugugggutt

SEQ ID NO: 1317 - DNA, 21 bp, Artificial Sequence
  siRNA
auaaaaggaaacaccucuutt

SEQ ID NO: 1318 - DNA, 21 bp, Artificial Sequence
  siRNA
auauaaaaggaaacaccuctt

SEQ ID NO: 1319 - DNA, 21 bp, Artificial Sequence
  siRNA
uuuguuggugguauugauutt

SEQ ID NO: 1320 - DNA, 21 bp, Artificial Sequence
  siRNA
auuuuguuggugguauugatt

SEQ ID NO: 1321 - DNA, 21 bp, Artificial Sequence
  siRNA
aaauauuuuguuggugguatt

SEQ ID NO: 1322 - DNA, 21 bp, Artificial Sequence
  siRNA
ucuacuuagaaauauuuugtt

SEQ ID NO: 1323 - DNA, 21 bp, Artificial Sequence
  siRNA
gugucuacuuagaaauauutt

SEQ ID NO: 1324 - DNA, 21 bp, Artificial Sequence
  siRNA
aagugucuacuuagaaauatt

SEQ ID NO: 1325 - DNA, 21 bp, Artificial Sequence
  siRNA
ggucuggaaaagugucuactt

SEQ ID NO: 1326 - DNA, 21 bp, Artificial Sequence
  siRNA
acaaaauccuaucugcagctt

SEQ ID NO: 1327 - DNA, 21 bp, Artificial Sequence
  siRNA
aaagaagcugccagaaguatt

SEQ ID NO: 1328 - DNA, 21 bp, Artificial Sequence
  siRNA
auauauguauauauauauatt

SEQ ID NO: 1329 - DNA, 21 bp, Artificial Sequence
  siRNA
uguucuucauaacuucugatt

SEQ ID NO: 1330 - DNA, 21 bp, Artificial Sequence
  siRNA
ucuuuuuguucuucauaactt

SEQ ID NO: 1331 - DNA, 21 bp, Artificial Sequence
  siRNA
uuauuuuuucuuuuuguuctt

SEQ ID NO: 1332 - DNA, 21 bp, Artificial Sequence
  siRNA
uguuuauuuuuucuuuuugtt

SEQ ID NO: 1333 - DNA, 21 bp, Artificial Sequence
  siRNA
cuguguuuauuuuuucuuutt

SEQ ID NO: 1334 - DNA, 21 bp, Artificial Sequence
  siRNA
uucuguguuuauuuuuucutt

SEQ ID NO: 1335 - DNA, 21 bp, Artificial Sequence
  siRNA
uugcuucuguguuuauuuutt

SEQ ID NO: 1336 - DNA, 21 bp, Artificial Sequence
  siRNA
acuugcuucuguguuuauutt

SEQ ID NO: 1337 - DNA, 21 bp, Artificial Sequence
  siRNA
gcacuugcuucuguguuuatt

SEQ ID NO: 1338 - DNA, 21 bp, Artificial Sequence
  siRNA
auugcacuugcuucugugutt

SEQ ID NO: 1339 - DNA, 21 bp, Artificial Sequence
  siRNA
gaggugguauugcacuugctt

SEQ ID NO: 1340 - DNA, 21 bp, Artificial Sequence
  siRNA
aagagaggugguauugcactt

SEQ ID NO: 1341 - DNA, 21 bp, Artificial Sequence
  siRNA
agggagaagagaggugguatt

SEQ ID NO: 1342 - DNA, 21 bp, Artificial Sequence
  siRNA
gagaaaggagaaaaacucutt

SEQ ID NO: 1343 - DNA, 21 bp, Artificial Sequence
  siRNA
aaagcuaguuuaacucccctt

SEQ ID NO: 1344 - DNA, 21 bp, Artificial Sequence
  siRNA
auaagucucaaaagcuagutt

SEQ ID NO: 1345 - DNA, 21 bp, Artificial Sequence
  siRNA
auuacauauacaaaaugcutt

SEQ ID NO: 1346 - DNA, 21 bp, Artificial Sequence
  siRNA
aauauuuacuuacaauauatt

SEQ ID NO: 1347 - DNA, 21 bp, Artificial Sequence
  siRNA
ccguuacacaaauauuuactt

SEQ ID NO: 1348 - DNA, 21 bp, Artificial Sequence
  siRNA
aucuccguuacacaaauautt

SEQ ID NO: 1349 - DNA, 21 bp, Artificial Sequence
  siRNA
uuacaguaguauaucuccgtt

SEQ ID NO: 1350 - DNA, 21 bp, Artificial Sequence
  siRNA
agccaguacaguacaaaactt

SEQ ID NO: 1351 - DNA, 21 bp, Artificial Sequence
  siRNA
uguuuauuuauaacagacutt

SEQ ID NO: 1352 - DNA, 21 bp, Artificial Sequence
  siRNA
uuaaauuacucauguuuautt

SEQ ID NO: 1353 - DNA, 21 bp, Artificial Sequence
  siRNA
gguguuaaauuacucaugutt

SEQ ID NO: 1354 - DNA, 21 bp, Artificial Sequence
  siRNA
uuuuuuuuuugguguuaaatt

SEQ ID NO: 1355 - DNA, 21 bp, Artificial Sequence
  siRNA
uuuuuuuuuuuuuuuggugtt

SEQ ID NO: 1356 - DNA, 21 bp, Artificial Sequence
  siRNA
uuuuuuuuuuuuuuuuuuutt

SEQ ID NO: 1357 - DNA, 21 bp, Artificial Sequence
  siRNA
gcuguccguguccugggcctt

SEQ ID NO: 1358 - DNA, 21 bp, Artificial Sequence
  siRNA
cagcaucugccuuucccuctt

SEQ ID NO: 1359 - DNA, 21 bp, Artificial Sequence
  siRNA
aagggaugcuguagccuagtt

SEQ ID NO: 1360 - DNA, 21 bp, Artificial Sequence
  siRNA
gggaugcuguagccuagcatt

SEQ ID NO: 1361 - DNA, 21 bp, Artificial Sequence
  siRNA
gcacauccaagcgugcucutt

SEQ ID NO: 1362 - DNA, 21 bp, Artificial Sequence
  siRNA
gcgugcucuccccucuccutt

SEQ ID NO: 1363 - DNA, 21 bp, Artificial Sequence
  siRNA
cacacauacacccugggcutt

SEQ ID NO: 1364 - DNA, 21 bp, Artificial Sequence
  siRNA
augacggcgguuccccucatt

SEQ ID NO: 1365 - DNA, 21 bp, Artificial Sequence
  siRNA
uccacgcuuccuggaaggutt

SEQ ID NO: 1366 - DNA, 21 bp, Artificial Sequence
  siRNA
ggugaguggcugggcucactt

SEQ ID NO: 1367 - DNA, 21 bp, Artificial Sequence
  siRNA
ggcggcggccgcguucgcatt

SEQ ID NO: 1368 - DNA, 21 bp, Artificial Sequence
  siRNA
gggaaggauaaucuggagatt

SEQ ID NO: 1369 - DNA, 21 bp, Artificial Sequence
  siRNA
ggauaaucuggagagggautt

SEQ ID NO: 1370 - DNA, 21 bp, Artificial Sequence
  siRNA
ucuggagagggaucccucatt

SEQ ID NO: 1371 - DNA, 21 bp, Artificial Sequence
  siRNA
gacuccaaccauuuuauaatt

SEQ ID NO: 1372 - DNA, 21 bp, Artificial Sequence
  siRNA
ccauuuuauaauggaaucutt

SEQ ID NO: 1373 - DNA, 21 bp, Artificial Sequence
  siRNA
uggaaucuuuauuuugugatt

SEQ ID NO: 1374 - DNA, 21 bp, Artificial Sequence
  siRNA
ucuuuauuuugugaaaguatt

SEQ ID NO: 1375 - DNA, 21 bp, Artificial Sequence
  siRNA
aguagcggggacucaucuctt

SEQ ID NO: 1376 - DNA, 21 bp, Artificial Sequence
  siRNA
ggaguuccucggggccccatt

SEQ ID NO: 1377 - DNA, 21 bp, Artificial Sequence
  siRNA
cagccagcacucuucuccutt

SEQ ID NO: 1378 - DNA, 21 bp, Artificial Sequence
  siRNA
cuccaucaagguggagaugtt

SEQ ID NO: 1379 - DNA, 21 bp, Artificial Sequence
  siRNA
gguggagauguacagcgautt

SEQ ID NO: 1380 - DNA, 21 bp, Artificial Sequence
  siRNA
gcagacugcuggggccagatt

SEQ ID NO: 1381 - DNA, 21 bp, Artificial Sequence
  siRNA
aaggacgacagcgugauugtt

SEQ ID NO: 1382 - DNA, 21 bp, Artificial Sequence
  siRNA
ggacgacagcgugauugugtt

SEQ ID NO: 1383 - DNA, 21 bp, Artificial Sequence
  siRNA
gauucauugucugagcccctt

SEQ ID NO: 1384 - DNA, 21 bp, Artificial Sequence
  siRNA
uggcaagcucaagugugactt

SEQ ID NO: 1385 - DNA, 21 bp, Artificial Sequence
  siRNA
gcucaagugugacgucugctt

SEQ ID NO: 1386 - DNA, 21 bp, Artificial Sequence
  siRNA
gugugacgucugcggcaugtt

SEQ ID NO: 1387 - DNA, 21 bp, Artificial Sequence
  siRNA
cgugcucauggugcacaagtt

SEQ ID NO: 1388 - DNA, 21 bp, Artificial Sequence
  siRNA
gcgcagucacacuggugaatt

SEQ ID NO: 1389 - DNA, 21 bp, Artificial Sequence
  siRNA
aggcccuuccauugcaacctt

SEQ ID NO: 1390 - DNA, 21 bp, Artificial Sequence
  siRNA
ccaguguggugccuccuuctt

SEQ ID NO: 1391 - DNA, 21 bp, Artificial Sequence
  siRNA
ggggaaccugcugcgccactt

SEQ ID NO: 1392 - DNA, 21 bp, Artificial Sequence
  siRNA
ccugcugcgccacaucaagtt

SEQ ID NO: 1393 - DNA, 21 bp, Artificial Sequence
  siRNA
gcugcacucuggggagaagtt

SEQ ID NO: 1394 - DNA, 21 bp, Artificial Sequence
  siRNA
gcccuuuaaaugucccuuctt

SEQ ID NO: 1395 - DNA, 21 bp, Artificial Sequence
  siRNA
augucccuucugcaacuautt

SEQ ID NO: 1396 - DNA, 21 bp, Artificial Sequence
  siRNA
cuaugccugccgccggcgutt

SEQ ID NO: 1397 - DNA, 21 bp, Artificial Sequence
  siRNA
gcccuacaaguguaacuactt

SEQ ID NO: 1398 - DNA, 21 bp, Artificial Sequence
  siRNA
guguaacuacuguggccggtt

SEQ ID NO: 1399 - DNA, 21 bp, Artificial Sequence
  siRNA
cuacuguggccggagcuactt

SEQ ID NO: 1400 - DNA, 21 bp, Artificial Sequence
  siRNA
acagcagaguacccuggagtt

SEQ ID NO: 1401 - DNA, 21 bp, Artificial Sequence
  siRNA
ggagcggugccauaacuactt

SEQ ID NO: 1402 - DNA, 21 bp, Artificial Sequence
  siRNA
cuaccuacagagucucagctt

SEQ ID NO: 1403 - DNA, 21 bp, Artificial Sequence
  siRNA
gcccaagcuuuggcuggcctt

SEQ ID NO: 1404 - DNA, 21 bp, Artificial Sequence
  siRNA
gcuuuggcuggccaaccagtt

SEQ ID NO: 1405 - DNA, 21 bp, Artificial Sequence
  siRNA
ccaggugacgaaauacgugtt

SEQ ID NO: 1406 - DNA, 21 bp, Artificial Sequence
  siRNA
auacgugaccuggagauggtt

SEQ ID NO: 1407 - DNA, 21 bp, Artificial Sequence
  siRNA
cuuucaucgaucgucuggctt

SEQ ID NO: 1408 - DNA, 21 bp, Artificial Sequence
  siRNA
uagccucaccaaacgcaagtt

SEQ ID NO: 1409 - DNA, 21 bp, Artificial Sequence
  siRNA
acgcaagcguuccacaccctt

SEQ ID NO: 1410 - DNA, 21 bp, Artificial Sequence
  siRNA
gcguuccacaccccagaagtt

SEQ ID NO: 1411 - DNA, 21 bp, Artificial Sequence
  siRNA
guuuguaggcgaaaagcagtt

SEQ ID NO: 1412 - DNA, 21 bp, Artificial Sequence
  siRNA
aagcagaugcgcuucagcctt

SEQ ID NO: 1413 - DNA, 21 bp, Artificial Sequence
  siRNA
gcagaugcgcuucagccuctt

SEQ ID NO: 1414 - DNA, 21 bp, Artificial Sequence
  siRNA
cucggguggcuaugaaaagtt

SEQ ID NO: 1415 - DNA, 21 bp, Artificial Sequence
  siRNA
aaggauguggaguugguggtt

SEQ ID NO: 1416 - DNA, 21 bp, Artificial Sequence
  siRNA
ggauguggaguugguggcatt

SEQ ID NO: 1417 - DNA, 21 bp, Artificial Sequence
  siRNA
guucccuggccuuugugggtt

SEQ ID NO: 1418 - DNA, 21 bp, Artificial Sequence
  siRNA
uugcaucucagaacucacgtt

SEQ ID NO: 1419 - DNA, 21 bp, Artificial Sequence
  siRNA
cucacgccugucaucagcutt

SEQ ID NO: 1420 - DNA, 21 bp, Artificial Sequence
  siRNA
gcaggugagggaccugaggtt

SEQ ID NO: 1421 - DNA, 21 bp, Artificial Sequence
  siRNA
uggcugccaggacuccacatt

SEQ ID NO: 1422 - DNA, 21 bp, Artificial Sequence
  siRNA
agcaaccacgaagaucgggtt

SEQ ID NO: 1423 - DNA, 21 bp, Artificial Sequence
  siRNA
ccacgaagaucggguugcgtt

SEQ ID NO: 1424 - DNA, 21 bp, Artificial Sequence
  siRNA
gaucggguugcggggguggtt

SEQ ID NO: 1425 - DNA, 21 bp, Artificial Sequence
  siRNA
agaggaccccaagccacagtt

SEQ ID NO: 1426 - DNA, 21 bp, Artificial Sequence
  siRNA
gccacaggagggguuauugtt

SEQ ID NO: 1427 - DNA, 21 bp, Artificial Sequence
  siRNA
ggaagugcuucggguggugtt

SEQ ID NO: 1428 - DNA, 21 bp, Artificial Sequence
  siRNA
gugcuucggguggugggcgtt

SEQ ID NO: 1429 - DNA, 21 bp, Artificial Sequence
  siRNA
ggccuucaagugugagcactt

SEQ ID NO: 1430 - DNA, 21 bp, Artificial Sequence
  siRNA
gugugagcacugccguauctt

SEQ ID NO: 1431 - DNA, 21 bp, Artificial Sequence
  siRNA
caucugugguuaucacagctt

SEQ ID NO: 1432 - DNA, 21 bp, Artificial Sequence
  siRNA
uucucuucccacauugucctt

SEQ ID NO: 1433 - DNA, 21 bp, Artificial Sequence
  siRNA
ggugggcuagcaaccucuctt

SEQ ID NO: 1434 - DNA, 21 bp, Artificial Sequence
  siRNA
ccucucccucucuccucagtt

SEQ ID NO: 1435 - DNA, 21 bp, Artificial Sequence
  siRNA
ggaguuuugcuuuguagcctt

SEQ ID NO: 1436 - DNA, 21 bp, Artificial Sequence
  siRNA
gcauugugaugaaacagautt

SEQ ID NO: 1437 - DNA, 21 bp, Artificial Sequence
  siRNA
acagaucuuuugcuuaugutt

SEQ ID NO: 1438 - DNA, 21 bp, Artificial Sequence
  siRNA
uuaguugauuuauuuuugctt

SEQ ID NO: 1439 - DNA, 21 bp, Artificial Sequence
  siRNA
auuuuaacuuauaucaguctt

SEQ ID NO: 1440 - DNA, 21 bp, Artificial Sequence
  siRNA
cuuauaucagucacuugcctt

SEQ ID NO: 1441 - DNA, 21 bp, Artificial Sequence
  siRNA
cuccuuuccacuuuaggcctt

SEQ ID NO: 1442 - DNA, 21 bp, Artificial Sequence
  siRNA
uuuuucucucuuagaucuutt

SEQ ID NO: 1443 - DNA, 21 bp, Artificial Sequence
  siRNA
gcuccucuuaguacuaagatt

SEQ ID NO: 1444 - DNA, 21 bp, Artificial Sequence
  siRNA
gagacuucaagcuucuugctt

SEQ ID NO: 1445 - DNA, 21 bp, Artificial Sequence
  siRNA
gcuucuugcuuuaaguccutt

SEQ ID NO: 1446 - DNA, 21 bp, Artificial Sequence
  siRNA
guccucacccuuuacauuatt

SEQ ID NO: 1447 - DNA, 21 bp, Artificial Sequence
  siRNA
uucuucaguuuugaugcugtt

SEQ ID NO: 1448 - DNA, 21 bp, Artificial Sequence
  siRNA
ccugguacuccauaccucutt

SEQ ID NO: 1449 - DNA, 21 bp, Artificial Sequence
  siRNA
ugaaugaagaauuauuucctt

SEQ ID NO: 1450 - DNA, 21 bp, Artificial Sequence
  siRNA
ugaagaauuauuuccucautt

SEQ ID NO: 1451 - DNA, 21 bp, Artificial Sequence
  siRNA
gaauuauuuccucauuuggtt

SEQ ID NO: 1452 - DNA, 21 bp, Artificial Sequence
  siRNA
uuauuuccucauuuggaagtt

SEQ ID NO: 1453 - DNA, 21 bp, Artificial Sequence
  siRNA
guaggagggacugaagaaatt

SEQ ID NO: 1454 - DNA, 21 bp, Artificial Sequence
  siRNA
gaaauucuccccaggcacutt

SEQ ID NO: 1455 - DNA, 21 bp, Artificial Sequence
  siRNA
auucuccccaggcacugugtt

SEQ ID NO: 1456 - DNA, 21 bp, Artificial Sequence
  siRNA
uaggucauauuccccuagutt

SEQ ID NO: 1457 - DNA, 21 bp, Artificial Sequence
  siRNA
uaugaguucucaaagccuatt

SEQ ID NO: 1458 - DNA, 21 bp, Artificial Sequence
  siRNA
agccuacauucaggaucuctt

SEQ ID NO: 1459 - DNA, 21 bp, Artificial Sequence
  siRNA
cuaccccuccacacgcucutt

SEQ ID NO: 1460 - DNA, 21 bp, Artificial Sequence
  siRNA
ccuaccggucuauuaagugtt

SEQ ID NO: 1461 - DNA, 21 bp, Artificial Sequence
  siRNA
gugguggcuuuucucuccutt

SEQ ID NO: 1462 - DNA, 21 bp, Artificial Sequence
  siRNA
uuuuauauucucaggggcctt

SEQ ID NO: 1463 - DNA, 21 bp, Artificial Sequence
  siRNA
ggcuaggucugcaacccuctt

SEQ ID NO: 1464 - DNA, 21 bp, Artificial Sequence
  siRNA
cccucugucucugacagautt

SEQ ID NO: 1465 - DNA, 21 bp, Artificial Sequence
  siRNA
uugggaaccagggcaugggtt

SEQ ID NO: 1466 - DNA, 21 bp, Artificial Sequence
  siRNA
ccagggcaugggaaaggagtt

SEQ ID NO: 1467 - DNA, 21 bp, Artificial Sequence
  siRNA
aggagugggucaaaauucutt

SEQ ID NO: 1468 - DNA, 21 bp, Artificial Sequence
  siRNA
aauucuucucuuucuccuctt

SEQ ID NO: 1469 - DNA, 21 bp, Artificial Sequence
  siRNA
uucuucucuuucuccuccatt

SEQ ID NO: 1470 - DNA, 21 bp, Artificial Sequence
  siRNA
acuucuucacuauagugactt

SEQ ID NO: 1471 - DNA, 21 bp, Artificial Sequence
  siRNA
acuaguggguugcugccugtt

SEQ ID NO: 1472 - DNA, 21 bp, Artificial Sequence
  siRNA
gggguuguuucagccccuctt

SEQ ID NO: 1473 - DNA, 21 bp, Artificial Sequence
  siRNA
acggguaucucuuuucucutt

SEQ ID NO: 1474 - DNA, 21 bp, Artificial Sequence
  siRNA
uuuucaguauaaccaaaaatt

SEQ ID NO: 1475 - DNA, 21 bp, Artificial Sequence
  siRNA
ccaaaaauuaucccagcautt

SEQ ID NO: 1476 - DNA, 21 bp, Artificial Sequence
  siRNA
aaauuaucccagcaugagctt

SEQ ID NO: 1477 - DNA, 21 bp, Artificial Sequence
  siRNA
auuaucccagcaugagcactt

SEQ ID NO: 1478 - DNA, 21 bp, Artificial Sequence
  siRNA
gacugggauggguacaacutt

SEQ ID NO: 1479 - DNA, 21 bp, Artificial Sequence
  siRNA
cugaacuggggucuuccuutt

SEQ ID NO: 1480 - DNA, 21 bp, Artificial Sequence
  siRNA
cuggggucuuccuuuacuatt

SEQ ID NO: 1481 - DNA, 21 bp, Artificial Sequence
  siRNA
ccuaggauuagugagaaggtt

SEQ ID NO: 1482 - DNA, 21 bp, Artificial Sequence
  siRNA
ggggcagaaggagauacaatt

SEQ ID NO: 1483 - DNA, 21 bp, Artificial Sequence
  siRNA
ggagauacaacuccacugctt

SEQ ID NO: 1484 - DNA, 21 bp, Artificial Sequence
  siRNA
cuccacugcaaguggaggutt

SEQ ID NO: 1485 - DNA, 21 bp, Artificial Sequence
  siRNA
guggagguuucuuucuacatt

SEQ ID NO: 1486 - DNA, 21 bp, Artificial Sequence
  siRNA
gaguuuucugcccaaggcctt

SEQ ID NO: 1487 - DNA, 21 bp, Artificial Sequence
  siRNA
ggccacagccaucccacuctt

SEQ ID NO: 1488 - DNA, 21 bp, Artificial Sequence
  siRNA
accaaaggcuguuuuucuatt

SEQ ID NO: 1489 - DNA, 21 bp, Artificial Sequence
  siRNA
aggcuguuuuucuauguuutt

SEQ ID NO: 1490 - DNA, 21 bp, Artificial Sequence
  siRNA
agaaaaaaaaaaguaaaaatt

SEQ ID NO: 1491 - DNA, 21 bp, Artificial Sequence
  siRNA
aaaaaaaaguaaaaaccaatt

SEQ ID NO: 1492 - DNA, 21 bp, Artificial Sequence
  siRNA
aaaaaaguaaaaaccaaactt

SEQ ID NO: 1493 - DNA, 21 bp, Artificial Sequence
  siRNA
aaaaguaaaaaccaaacactt

SEQ ID NO: 1494 - DNA, 21 bp, Artificial Sequence
  siRNA
aaguaaaaaccaaacacaatt

SEQ ID NO: 1495 - DNA, 21 bp, Artificial Sequence
  siRNA
guaaaaaccaaacacaacatt

SEQ ID NO: 1496 - DNA, 21 bp, Artificial Sequence
  siRNA
aaaccaaacacaacaccuctt

SEQ ID NO: 1497 - DNA, 21 bp, Artificial Sequence
  siRNA
accaaacacaacaccucactt

SEQ ID NO: 1498 - DNA, 21 bp, Artificial Sequence
  siRNA
acacaacaccucacaaguutt

SEQ ID NO: 1499 - DNA, 21 bp, Artificial Sequence
  siRNA
caccucacaaguuguaacutt

SEQ ID NO: 1500 - DNA, 21 bp, Artificial Sequence
  siRNA
guuguaacucuugguccuutt

SEQ ID NO: 1501 - DNA, 21 bp, Artificial Sequence
  siRNA
cucuugguccuucucucuctt

SEQ ID NO: 1502 - DNA, 21 bp, Artificial Sequence
  siRNA
agggugggcuaaggaacagtt

SEQ ID NO: 1503 - DNA, 21 bp, Artificial Sequence
  siRNA
ggaacagacccugggauuatt

SEQ ID NO: 1504 - DNA, 21 bp, Artificial Sequence
  siRNA
cagacccugggauuagggctt

SEQ ID NO: 1505 - DNA, 21 bp, Artificial Sequence
  siRNA
gggcucugagaggagucuatt

SEQ ID NO: 1506 - DNA, 21 bp, Artificial Sequence
  siRNA
gggagacccuaaaaaacuutt

SEQ ID NO: 1507 - DNA, 21 bp, Artificial Sequence
  siRNA
aaaacuuucuccucuuugutt

SEQ ID NO: 1508 - DNA, 21 bp, Artificial Sequence
  siRNA
aacuuucuccucuuugucctt

SEQ ID NO: 1509 - DNA, 21 bp, Artificial Sequence
  siRNA
cuuucuccucuuuguccuctt

SEQ ID NO: 1510 - DNA, 21 bp, Artificial Sequence
  siRNA
gagaaccagauuggcagggtt

SEQ ID NO: 1511 - DNA, 21 bp, Artificial Sequence
  siRNA
ccagauuggcagggagaagtt

SEQ ID NO: 1512 - DNA, 21 bp, Artificial Sequence
  siRNA
gcauuguggggcaauuguutt

SEQ ID NO: 1513 - DNA, 21 bp, Artificial Sequence
  siRNA
uuguuccuccuugacaaugtt

SEQ ID NO: 1514 - DNA, 21 bp, Artificial Sequence
  siRNA
uguagcaauaaauagaugctt

SEQ ID NO: 1515 - DNA, 21 bp, Artificial Sequence
  siRNA
uaaauagaugcugccaaggtt

SEQ ID NO: 1516 - DNA, 21 bp, Artificial Sequence
  siRNA
auagaugcugccaagggcatt

SEQ ID NO: 1517 - DNA, 21 bp, Artificial Sequence
  siRNA
gggcagaaaauggggaggutt

SEQ ID NO: 1518 - DNA, 21 bp, Artificial Sequence
  siRNA
aauggggagguuagcucagtt

SEQ ID NO: 1519 - DNA, 21 bp, Artificial Sequence
  siRNA
uggggagguuagcucagagtt

SEQ ID NO: 1520 - DNA, 21 bp, Artificial Sequence
  siRNA
aggaagaauccucaacggctt

SEQ ID NO: 1521 - DNA, 21 bp, Artificial Sequence
  siRNA
gaauccucaacggcacccutt

SEQ ID NO: 1522 - DNA, 21 bp, Artificial Sequence
  siRNA
uccucaacggcacccugggtt

SEQ ID NO: 1523 - DNA, 21 bp, Artificial Sequence
  siRNA
cggcacccuggggugcuagtt

SEQ ID NO: 1524 - DNA, 21 bp, Artificial Sequence
  siRNA
ugucagcagagcugagauutt

SEQ ID NO: 1525 - DNA, 21 bp, Artificial Sequence
  siRNA
uaucugggcuuuuccugaatt

SEQ ID NO: 1526 - DNA, 21 bp, Artificial Sequence
  siRNA
cuauucugguuauugagcctt

SEQ ID NO: 1527 - DNA, 21 bp, Artificial Sequence
  siRNA
ggacuagucccuucuggggtt

SEQ ID NO: 1528 - DNA, 21 bp, Artificial Sequence
  siRNA
cuguggcaccuguaaccuctt

SEQ ID NO: 1529 - DNA, 21 bp, Artificial Sequence
  siRNA
ccucccggaacaugaaggatt

SEQ ID NO: 1530 - DNA, 21 bp, Artificial Sequence
  siRNA
caugaaggacuaugcucugtt

SEQ ID NO: 1531 - DNA, 21 bp, Artificial Sequence
  siRNA
ggacuaugcucugaggcuatt

SEQ ID NO: 1532 - DNA, 21 bp, Artificial Sequence
  siRNA
gggcaagaccaggugcuaatt

SEQ ID NO: 1533 - DNA, 21 bp, Artificial Sequence
  siRNA
gaccaggugcuaaggagggtt

SEQ ID NO: 1534 - DNA, 21 bp, Artificial Sequence
  siRNA
ggaggggagagggggcauctt

SEQ ID NO: 1535 - DNA, 21 bp, Artificial Sequence
  siRNA
ccagggucuuagguacaaatt

SEQ ID NO: 1536 - DNA, 21 bp, Artificial Sequence
  siRNA
aauccuacuuuucagagcctt

SEQ ID NO: 1537 - DNA, 21 bp, Artificial Sequence
  siRNA
uccuacuuuucagagccuutt

SEQ ID NO: 1538 - DNA, 21 bp, Artificial Sequence
  siRNA
ccucaaacauccucaugcutt

SEQ ID NO: 1539 - DNA, 21 bp, Artificial Sequence
  siRNA
acauccucaugcucucucctt

SEQ ID NO: 1540 - DNA, 21 bp, Artificial Sequence
  siRNA
aaaaaaaaguaaagaaaaatt

SEQ ID NO: 1541 - DNA, 21 bp, Artificial Sequence
  siRNA
aaaaaaguaaagaaaaagatt

SEQ ID NO: 1542 - DNA, 21 bp, Artificial Sequence
  siRNA
aaaaguaaagaaaaagaaatt

SEQ ID NO: 1543 - DNA, 21 bp, Artificial Sequence
  siRNA
aaguaaagaaaaagaaaaatt

SEQ ID NO: 1544 - DNA, 21 bp, Artificial Sequence
  siRNA
guaaagaaaaagaaaaaaatt

SEQ ID NO: 1545 - DNA, 21 bp, Artificial Sequence
  siRNA
agaaaaagaaaaaaaaauatt

SEQ ID NO: 1546 - DNA, 21 bp, Artificial Sequence
  siRNA
aaagaaaaaaaaauacacatt

SEQ ID NO: 1547 - DNA, 21 bp, Artificial Sequence
  siRNA
agaaaaaaaaauacacacatt

SEQ ID NO: 1548 - DNA, 21 bp, Artificial Sequence
  siRNA
aaaaaaauacacacacacutt

SEQ ID NO: 1549 - DNA, 21 bp, Artificial Sequence
  siRNA
aaaaauacacacacacugatt

SEQ ID NO: 1550 - DNA, 21 bp, Artificial Sequence
  siRNA
aaauacacacacacugaaatt

SEQ ID NO: 1551 - DNA, 21 bp, Artificial Sequence
  siRNA
auacacacacacugaaacctt

SEQ ID NO: 1552 - DNA, 21 bp, Artificial Sequence
  siRNA
acccacauggagaaaagagtt

SEQ ID NO: 1553 - DNA, 21 bp, Artificial Sequence
  siRNA
aagagguguuuccuuuuautt

SEQ ID NO: 1554 - DNA, 21 bp, Artificial Sequence
  siRNA
gagguguuuccuuuuauautt

SEQ ID NO: 1555 - DNA, 21 bp, Artificial Sequence
  siRNA
aaucaauaccaccaacaaatt

SEQ ID NO: 1556 - DNA, 21 bp, Artificial Sequence
  siRNA
ucaauaccaccaacaaaautt

SEQ ID NO: 1557 - DNA, 21 bp, Artificial Sequence
  siRNA
uaccaccaacaaaauauuutt

SEQ ID NO: 1558 - DNA, 21 bp, Artificial Sequence
  siRNA
caaaauauuucuaaguagatt

SEQ ID NO: 1559 - DNA, 21 bp, Artificial Sequence
  siRNA
aauauuucuaaguagacactt

SEQ ID NO: 1560 - DNA, 21 bp, Artificial Sequence
  siRNA
uauuucuaaguagacacuutt

SEQ ID NO: 1561 - DNA, 21 bp, Artificial Sequence
  siRNA
guagacacuuuuccagacctt

SEQ ID NO: 1562 - DNA, 21 bp, Artificial Sequence
  siRNA
gcugcagauaggauuuugutt

SEQ ID NO: 1563 - DNA, 21 bp, Artificial Sequence
  siRNA
uacuucuggcagcuucuuutt

SEQ ID NO: 1564 - DNA, 21 bp, Artificial Sequence
  siRNA
uauauauauauacauauautt

SEQ ID NO: 1565 - DNA, 21 bp, Artificial Sequence
  siRNA
ucagaaguuaugaagaacatt

SEQ ID NO: 1566 - DNA, 21 bp, Artificial Sequence
  siRNA
guuaugaagaacaaaaagatt

SEQ ID NO: 1567 - DNA, 21 bp, Artificial Sequence
  siRNA
gaacaaaaagaaaaaauaatt

SEQ ID NO: 1568 - DNA, 21 bp, Artificial Sequence
  siRNA
caaaaagaaaaaauaaacatt

SEQ ID NO: 1569 - DNA, 21 bp, Artificial Sequence
  siRNA
aaagaaaaaauaaacacagtt

SEQ ID NO: 1570 - DNA, 21 bp, Artificial Sequence
  siRNA
agaaaaaauaaacacagaatt

SEQ ID NO: 1571 - DNA, 21 bp, Artificial Sequence
  siRNA
aaaauaaacacagaagcaatt

SEQ ID NO: 1572 - DNA, 21 bp, Artificial Sequence
  siRNA
aauaaacacagaagcaagutt

SEQ ID NO: 1573 - DNA, 21 bp, Artificial Sequence
  siRNA
uaaacacagaagcaagugctt

SEQ ID NO: 1574 - DNA, 21 bp, Artificial Sequence
  siRNA
acacagaagcaagugcaautt

SEQ ID NO: 1575 - DNA, 21 bp, Artificial Sequence
  siRNA
gcaagugcaauaccaccuctt

SEQ ID NO: 1576 - DNA, 21 bp, Artificial Sequence
  siRNA
gugcaauaccaccucucuutt

SEQ ID NO: 1577 - DNA, 21 bp, Artificial Sequence
  siRNA
uaccaccucucuucucccutt

SEQ ID NO: 1578 - DNA, 21 bp, Artificial Sequence
  siRNA
agaguuuuucuccuuucuctt

SEQ ID NO: 1579 - DNA, 21 bp, Artificial Sequence
  siRNA
ggggaguuaaacuagcuuutt

SEQ ID NO: 1580 - DNA, 21 bp, Artificial Sequence
  siRNA
acuagcuuuugagacuuautt

SEQ ID NO: 1581 - DNA, 21 bp, Artificial Sequence
  siRNA
agcauuuuguauauguaautt

SEQ ID NO: 1582 - DNA, 21 bp, Artificial Sequence
  siRNA
uauauuguaaguaaauauutt

SEQ ID NO: 1583 - DNA, 21 bp, Artificial Sequence
  siRNA
guaaauauuuguguaacggtt

SEQ ID NO: 1584 - DNA, 21 bp, Artificial Sequence
  siRNA
auauuuguguaacggagautt

SEQ ID NO: 1585 - DNA, 21 bp, Artificial Sequence
  siRNA
cggagauauacuacuguaatt

SEQ ID NO: 1586 - DNA, 21 bp, Artificial Sequence
  siRNA
guuuuguacuguacuggcutt

SEQ ID NO: 1587 - DNA, 21 bp, Artificial Sequence
  siRNA
agucuguuauaaauaaacatt

SEQ ID NO: 1588 - DNA, 21 bp, Artificial Sequence
  siRNA
auaaacaugaguaauuuaatt

SEQ ID NO: 1589 - DNA, 21 bp, Artificial Sequence
  siRNA
acaugaguaauuuaacacctt

SEQ ID NO: 1590 - DNA, 21 bp, Artificial Sequence
  siRNA
uuuaacaccaaaaaaaaaatt

SEQ ID NO: 1591 - DNA, 21 bp, Artificial Sequence
  siRNA
caccaaaaaaaaaaaaaaatt

SEQ ID NO: 1592 - DNA, 21 bp, Artificial Sequence
  siRNA
aaaaaaaaaaaaaaaaaaatt

SEQ ID NO: 1593 - DNA, 21 bp, Artificial Sequence
  siRNA
ggggaggggauuuccaggctt

SEQ ID NO: 1594 - DNA, 21 bp, Artificial Sequence
  siRNA
agggggaaggggaggggautt

SEQ ID NO: 1595 - DNA, 21 bp, Artificial Sequence
  siRNA
ucugcuagucauggccagatt

SEQ ID NO: 1596 - DNA, 21 bp, Artificial Sequence
  siRNA
ccauugggccuagcugugctt

SEQ ID NO: 1597 - DNA, 21 bp, Artificial Sequence
  siRNA
gcuggccugggguugcccatt

SEQ ID NO: 1598 - DNA, 21 bp, Artificial Sequence
  siRNA
aaauuuugcuggccuggggtt

SEQ ID NO: 1599 - DNA, 21 bp, Artificial Sequence
  siRNA
caauuugaacuggcaaauutt

SEQ ID NO: 1600 - DNA, 21 bp, Artificial Sequence
  siRNA
accaauuugaacuggcaaatt

SEQ ID NO: 1601 - DNA, 21 bp, Artificial Sequence
  siRNA
uucucccagcaggaccaautt

SEQ ID NO: 1602 - DNA, 21 bp, Artificial Sequence
  siRNA
uugacuuucccacugcagatt

SEQ ID NO: 1603 - DNA, 21 bp, Artificial Sequence
  siRNA
cguaauaccaggcuugacutt

SEQ ID NO: 1604 - DNA, 21 bp, Artificial Sequence
  siRNA
acaaaacguaauaccaggctt

SEQ ID NO: 1605 - DNA, 21 bp, Artificial Sequence
  siRNA
guacucauggaacugcccutt

SEQ ID NO: 1606 - DNA, 21 bp, Artificial Sequence
  siRNA
cagaucucaaacuucacugtt

SEQ ID NO: 1607 - DNA, 21 bp, Artificial Sequence
  siRNA
ugugucccagaucucaaactt

SEQ ID NO: 1608 - DNA, 21 bp, Artificial Sequence
  siRNA
cguaaaccacgauugcagctt

SEQ ID NO: 1609 - DNA, 21 bp, Artificial Sequence
  siRNA
guaaugucguaaaccacgatt

SEQ ID NO: 1610 - DNA, 21 bp, Artificial Sequence
  siRNA
ucgggcaaagguuuccugatt

SEQ ID NO: 1611 - DNA, 21 bp, Artificial Sequence
  siRNA
ucuuugcucgggcaaaggutt

SEQ ID NO: 1612 - DNA, 21 bp, Artificial Sequence
  siRNA
aguuccuucacccaugucutt

SEQ ID NO: 1613 - DNA, 21 bp, Artificial Sequence
  siRNA
ggccugucgcuguaguucctt

SEQ ID NO: 1614 - DNA, 21 bp, Artificial Sequence
  siRNA
gacuggccugucgcuguagtt

SEQ ID NO: 1615 - DNA, 21 bp, Artificial Sequence
  siRNA
guuggccaggucagcuuugtt

SEQ ID NO: 1616 - DNA, 21 bp, Artificial Sequence
  siRNA
uuuguuggccaggucagcutt

SEQ ID NO: 1617 - DNA, 21 bp, Artificial Sequence
  siRNA
auacuccaccauacguuugtt

SEQ ID NO: 1618 - DNA, 21 bp, Artificial Sequence
  siRNA
uucauacuccaccauacgutt

SEQ ID NO: 1619 - DNA, 21 bp, Artificial Sequence
  siRNA
cugcauaugccugggccuctt

SEQ ID NO: 1620 - DNA, 21 bp, Artificial Sequence
  siRNA
cuccaugaacaauaagcugtt

SEQ ID NO: 1621 - DNA, 21 bp, Artificial Sequence
  siRNA
auucacguucauagcuguctt

SEQ ID NO: 1622 - DNA, 21 bp, Artificial Sequence
  siRNA
caggaagagaucauucacgtt

SEQ ID NO: 1623 - DNA, 21 bp, Artificial Sequence
  siRNA
uauugccaggaagagaucatt

SEQ ID NO: 1624 - DNA, 21 bp, Artificial Sequence
  siRNA
uuuggcaacuucuuagcuatt

SEQ ID NO: 1625 - DNA, 21 bp, Artificial Sequence
  siRNA
uucacucuuuggcaacuuctt

SEQ ID NO: 1626 - DNA, 21 bp, Artificial Sequence
  siRNA
ggguucacucuuuggcaactt

SEQ ID NO: 1627 - DNA, 21 bp, Artificial Sequence
  siRNA
agauucugggguucacucutt

SEQ ID NO: 1628 - DNA, 21 bp, Artificial Sequence
  siRNA
caccucccagauucuggggtt

SEQ ID NO: 1629 - DNA, 21 bp, Artificial Sequence
  siRNA
gccugcugcaccucccagatt

SEQ ID NO: 1630 - DNA, 21 bp, Artificial Sequence
  siRNA
uggagauccacaccccggctt

SEQ ID NO: 1631 - DNA, 21 bp, Artificial Sequence
  siRNA
ucuuguucugcugggacugtt

SEQ ID NO: 1632 - DNA, 21 bp, Artificial Sequence
  siRNA
gcuacaacacuggcucuugtt

SEQ ID NO: 1633 - DNA, 21 bp, Artificial Sequence
  siRNA
guugcuacaacacuggcuctt

SEQ ID NO: 1634 - DNA, 21 bp, Artificial Sequence
  siRNA
cugcuagccacccccucagtt

SEQ ID NO: 1635 - DNA, 21 bp, Artificial Sequence
  siRNA
gugcuagcuccauacuugutt

SEQ ID NO: 1636 - DNA, 21 bp, Artificial Sequence
  siRNA
ucuugugcuagcuccauactt

SEQ ID NO: 1637 - DNA, 21 bp, Artificial Sequence
  siRNA
ggagguuauuucuuagcuctt

SEQ ID NO: 1638 - DNA, 21 bp, Artificial Sequence
  siRNA
uagggauggagguuauuuctt

SEQ ID NO: 1639 - DNA, 21 bp, Artificial Sequence
  siRNA
ggguagggauggagguuautt

SEQ ID NO: 1640 - DNA, 21 bp, Artificial Sequence
  siRNA
ugagggguagggauggaggtt

SEQ ID NO: 1641 - DNA, 21 bp, Artificial Sequence
  siRNA
ugugcuguuaccguaggggtt

SEQ ID NO: 1642 - DNA, 21 bp, Artificial Sequence
  siRNA
gccagggcucagugugcugtt

SEQ ID NO: 1643 - DNA, 21 bp, Artificial Sequence
  siRNA
agcugucaggaggcagccctt

SEQ ID NO: 1644 - DNA, 21 bp, Artificial Sequence
  siRNA
gguguuuguugcugaagcgtt

SEQ ID NO: 1645 - DNA, 21 bp, Artificial Sequence
  siRNA
aacagcugccugguguuugtt

SEQ ID NO: 1646 - DNA, 21 bp, Artificial Sequence
  siRNA
ggcaacagcugccuggugutt

SEQ ID NO: 1647 - DNA, 21 bp, Artificial Sequence
  siRNA
agguaaguccuggggggagtt

SEQ ID NO: 1648 - DNA, 21 bp, Artificial Sequence
  siRNA
aaagugaagaaaguuuguutt

SEQ ID NO: 1649 - DNA, 21 bp, Artificial Sequence
  siRNA
acaaagugaagaaaguuugtt

SEQ ID NO: 1650 - DNA, 21 bp, Artificial Sequence
  siRNA
aauacaaagugaagaaagutt

SEQ ID NO: 1651 - DNA, 21 bp, Artificial Sequence
  siRNA
agauacguaagucgcuguctt

SEQ ID NO: 1652 - DNA, 21 bp, Artificial Sequence
  siRNA
gacaggagucagaaguguutt

SEQ ID NO: 1653 - DNA, 21 bp, Artificial Sequence
  siRNA
gggacaggagucagaagugtt

SEQ ID NO: 1654 - DNA, 21 bp, Artificial Sequence
  siRNA
aguuccuggguucaccacutt

SEQ ID NO: 1655 - DNA, 21 bp, Artificial Sequence
  siRNA
uccuuccucaguuccugggtt

SEQ ID NO: 1656 - DNA, 21 bp, Artificial Sequence
  siRNA
uggaaaccuccuuccucagtt

SEQ ID NO: 1657 - DNA, 21 bp, Artificial Sequence
  siRNA
aaaugaacuggaaaccucctt

SEQ ID NO: 1658 - DNA, 21 bp, Artificial Sequence
  siRNA
uuauucucccccagggccctt

SEQ ID NO: 1659 - DNA, 21 bp, Artificial Sequence
  siRNA
ccuccugcucugagcuuuatt

SEQ ID NO: 1660 - DNA, 21 bp, Artificial Sequence
  siRNA
cucccuccugcucugagcutt

SEQ ID NO: 1661 - DNA, 21 bp, Artificial Sequence
  siRNA
acaaaaaggaaauguuucctt

SEQ ID NO: 1662 - DNA, 21 bp, Artificial Sequence
  siRNA
aaaaacaaaaaggaaaugutt

SEQ ID NO: 1663 - DNA, 21 bp, Artificial Sequence
  siRNA
ucauggauaccgcaauguutt

SEQ ID NO: 1664 - DNA, 21 bp, Artificial Sequence
  siRNA
aaucauggauaccgcaaugtt

SEQ ID NO: 1665 - DNA, 21 bp, Artificial Sequence
  siRNA
cugagaucuugccuccccatt

SEQ ID NO: 1666 - DNA, 21 bp, Artificial Sequence
  siRNA
cugccuggugccugagauctt

SEQ ID NO: 1667 - DNA, 21 bp, Artificial Sequence
  siRNA
ccaccuccgcccaguuagctt

SEQ ID NO: 1668 - DNA, 21 bp, Artificial Sequence
  siRNA
caccuccaccuccgcccagtt

SEQ ID NO: 1669 - DNA, 21 bp, Artificial Sequence
  siRNA
aagaguuacagagccacagtt

SEQ ID NO: 1670 - DNA, 21 bp, Artificial Sequence
  siRNA
aaacugggccuuugaagagtt

SEQ ID NO: 1671 - DNA, 21 bp, Artificial Sequence
  siRNA
gugaggggaaacugggccutt

SEQ ID NO: 1672 - DNA, 21 bp, Artificial Sequence
  siRNA
ugggguccaacccccacgatt

SEQ ID NO: 1673 - DNA, 21 bp, Artificial Sequence
  siRNA
ggcaaccagugaaaauucutt

SEQ ID NO: 1674 - DNA, 21 bp, Artificial Sequence
  siRNA
ugcaggcaaccagugaaaatt

SEQ ID NO: 1675 - DNA, 21 bp, Artificial Sequence
  siRNA
ccaacugaacuaccaucaatt

SEQ ID NO: 1676 - DNA, 21 bp, Artificial Sequence
  siRNA
caaguaaaucaaucaaaactt

SEQ ID NO: 1677 - DNA, 21 bp, Artificial Sequence
  siRNA
aaccucagauuucauugaatt

SEQ ID NO: 1678 - DNA, 21 bp, Artificial Sequence
  siRNA
gcauuaaccucagauuucatt

SEQ ID NO: 1679 - DNA, 21 bp, Artificial Sequence
  siRNA
ccucgcauuaaccucagautt

SEQ ID NO: 1680 - DNA, 21 bp, Artificial Sequence
  siRNA
ccucuccucgaaccucgcatt

SEQ ID NO: 1681 - DNA, 21 bp, Artificial Sequence
  siRNA
guagcugccacugguaguutt

SEQ ID NO: 1682 - DNA, 21 bp, Artificial Sequence
  siRNA
gaguagcugccacugguagtt

SEQ ID NO: 1683 - DNA, 21 bp, Artificial Sequence
  siRNA
cuaacaguggagauaggactt

SEQ ID NO: 1684 - DNA, 21 bp, Artificial Sequence
  siRNA
uauagguuaauaauuagagtt

SEQ ID NO: 1685 - DNA, 21 bp, Artificial Sequence
  siRNA
caagaauauagguuaauaatt

SEQ ID NO: 1686 - DNA, 21 bp, Artificial Sequence
  siRNA
agcuuggcaagaauauaggtt

SEQ ID NO: 1687 - DNA, 21 bp, Artificial Sequence
  siRNA
ccuauagucaauaguuagctt

SEQ ID NO: 1688 - DNA, 21 bp, Artificial Sequence
  siRNA
gcaaaccuauagucaauagtt

SEQ ID NO: 1689 - DNA, 21 bp, Artificial Sequence
  siRNA
uccucaauugcucaauuaatt

SEQ ID NO: 1690 - DNA, 21 bp, Artificial Sequence
  siRNA
acacuccucaauugcucaatt

SEQ ID NO: 1691 - DNA, 21 bp, Artificial Sequence
  siRNA
auccugagacacuccucaatt

SEQ ID NO: 1692 - DNA, 21 bp, Artificial Sequence
  siRNA
uccuuuuuacuccccuacctt

SEQ ID NO: 1693 - DNA, 21 bp, Artificial Sequence
  siRNA
cuuuugccugaccuccuuutt

SEQ ID NO: 1694 - DNA, 21 bp, Artificial Sequence
  siRNA
cccuuuugccugaccuccutt

SEQ ID NO: 1695 - DNA, 21 bp, Artificial Sequence
  siRNA
gacagaaaacuccucccuutt

SEQ ID NO: 1696 - DNA, 21 bp, Artificial Sequence
  siRNA
aggacagaaaacuccuccctt

SEQ ID NO: 1697 - DNA, 21 bp, Artificial Sequence
  siRNA
caugguaauggauaucaaatt

SEQ ID NO: 1698 - DNA, 21 bp, Artificial Sequence
  siRNA
gaauaaagaucauaccuautt

SEQ ID NO: 1699 - DNA, 21 bp, Artificial Sequence
  siRNA
agggacuaaauucaagauatt

SEQ ID NO: 1700 - DNA, 21 bp, Artificial Sequence
  siRNA
uaaggauggagggacuaaatt

SEQ ID NO: 1701 - DNA, 21 bp, Artificial Sequence
  siRNA
auggggagggauggggggatt

SEQ ID NO: 1702 - DNA, 21 bp, Artificial Sequence
  siRNA
acauggauuaaaccacuggtt

SEQ ID NO: 1703 - DNA, 21 bp, Artificial Sequence
  siRNA
gccccuauugguacauggatt

SEQ ID NO: 1704 - DNA, 21 bp, Artificial Sequence
  siRNA
ucugugguacuagccccuatt

SEQ ID NO: 1705 - DNA, 21 bp, Artificial Sequence
  siRNA
guaccuucagugccggucatt

SEQ ID NO: 1706 - DNA, 21 bp, Artificial Sequence
  siRNA
gagccaguuguaagguacctt

SEQ ID NO: 1707 - DNA, 21 bp, Artificial Sequence
  siRNA
cucugauaauaugagccagtt

SEQ ID NO: 1708 - DNA, 21 bp, Artificial Sequence
  siRNA
augaagagagacuagagautt

SEQ ID NO: 1709 - DNA, 21 bp, Artificial Sequence
  siRNA
auggcuucucagagacauctt

SEQ ID NO: 1710 - DNA, 21 bp, Artificial Sequence
  siRNA
ucucuuuugccuugauggctt

SEQ ID NO: 1711 - DNA, 21 bp, Artificial Sequence
  siRNA
cuuaaaguucucuuuugcctt

SEQ ID NO: 1712 - DNA, 21 bp, Artificial Sequence
  siRNA
aggaacuuaaaguucucuutt

SEQ ID NO: 1713 - DNA, 21 bp, Artificial Sequence
  siRNA
caaggaacuuaaaguucuctt

SEQ ID NO: 1714 - DNA, 21 bp, Artificial Sequence
  siRNA
uggaacaaggaacuuaaagtt

SEQ ID NO: 1715 - DNA, 21 bp, Artificial Sequence
  siRNA
ccgggcuggaacaaggaactt

SEQ ID NO: 1716 - DNA, 21 bp, Artificial Sequence
  siRNA
ugaccuuuccuuucuuucutt

SEQ ID NO: 1717 - DNA, 21 bp, Artificial Sequence
  siRNA
acugugaccuuuccuuucutt

SEQ ID NO: 1718 - DNA, 21 bp, Artificial Sequence
  siRNA
ggucacugugaccuuuccutt

SEQ ID NO: 1719 - DNA, 21 bp, Artificial Sequence
  siRNA
uccuaggucacugugaccutt

SEQ ID NO: 1720 - DNA, 21 bp, Artificial Sequence
  siRNA
agccaaaagggcaggaaggtt

SEQ ID NO: 1721 - DNA, 21 bp, Artificial Sequence
  siRNA
uucauagauuucucagcugtt

SEQ ID NO: 1722 - DNA, 21 bp, Artificial Sequence
  siRNA
gaaucucagcuucauagautt

SEQ ID NO: 1723 - DNA, 21 bp, Artificial Sequence
  siRNA
gguccuucagaaucucagctt

SEQ ID NO: 1724 - DNA, 21 bp, Artificial Sequence
  siRNA
aagaaccuaagcugggucctt

SEQ ID NO: 1725 - DNA, 21 bp, Artificial Sequence
  siRNA
cccuggaaaaggaagggaatt

SEQ ID NO: 1726 - DNA, 21 bp, Artificial Sequence
  siRNA
aagggggaaaugugugugutt

SEQ ID NO: 1727 - DNA, 21 bp, Artificial Sequence
  siRNA
gcuauggggggccaguggctt

SEQ ID NO: 1728 - DNA, 21 bp, Artificial Sequence
  siRNA
gccauccuaguucuuccactt

SEQ ID NO: 1729 - DNA, 21 bp, Artificial Sequence
  siRNA
uggaaagccauccuaguuctt

SEQ ID NO: 1730 - DNA, 21 bp, Artificial Sequence
  siRNA
cuuuggaaagccauccuagtt

SEQ ID NO: 1731 - DNA, 21 bp, Artificial Sequence
  siRNA
acuucauuucuagaagacutt

SEQ ID NO: 1732 - DNA, 21 bp, Artificial Sequence
  siRNA
cacagagaaagaacuucautt

SEQ ID NO: 1733 - DNA, 21 bp, Artificial Sequence
  siRNA
agcugcacagagaaagaactt

SEQ ID NO: 1734 - DNA, 21 bp, Artificial Sequence
  siRNA
cccaagauaaugaaacauctt

SEQ ID NO: 1735 - DNA, 21 bp, Artificial Sequence
  siRNA
agaagccuggggaaguggutt

SEQ ID NO: 1736 - DNA, 21 bp, Artificial Sequence
  siRNA
aagcuaaggccaaauccugtt

SEQ ID NO: 1737 - DNA, 21 bp, Artificial Sequence
  siRNA
aaaaccacaacaccccccctt

SEQ ID NO: 1738 - DNA, 21 bp, Artificial Sequence
  siRNA
aggaagaaaggcaaaugcutt

SEQ ID NO: 1739 - DNA, 21 bp, Artificial Sequence
  siRNA
uguuaccacgauuguuaugtt

SEQ ID NO: 1740 - DNA, 21 bp, Artificial Sequence
  siRNA
cauucuguuaccacgauugtt

SEQ ID NO: 1741 - DNA, 21 bp, Artificial Sequence
  siRNA
ucgcauucuguuaccacgatt

SEQ ID NO: 1742 - DNA, 21 bp, Artificial Sequence
  siRNA
aaucagcagucgcauucugtt

SEQ ID NO: 1743 - DNA, 21 bp, Artificial Sequence
  siRNA
cgguaaaucagcagucgcatt

SEQ ID NO: 1744 - DNA, 21 bp, Artificial Sequence
  siRNA
uuuccuuuuuuuacuuacatt

SEQ ID NO: 1745 - DNA, 21 bp, Artificial Sequence
  siRNA
cuuuuuuuccuuuuuuuactt

SEQ ID NO: 1746 - DNA, 21 bp, Artificial Sequence
  siRNA
uuuucuuuuuuuccuuuuutt

SEQ ID NO: 1747 - DNA, 21 bp, Artificial Sequence
  siRNA
uuuuuucuuuuuuuccuuutt

SEQ ID NO: 1748 - DNA, 21 bp, Artificial Sequence
  siRNA
uuuuuuuucuuuuuuuccutt

SEQ ID NO: 1749 - DNA, 21 bp, Artificial Sequence
  siRNA
uuuuuuuuuuuuucuuuuutt

SEQ ID NO: 1750 - DNA, 21 bp, Artificial Sequence
  siRNA
uuuuuuuuuuuuuuucuuutt

SEQ ID NO: 1751 - DNA, 21 bp, Artificial Sequence
  siRNA
uuuuuuuuuuuuuuuuucutt

SEQ ID NO: 1752 - DNA, 21 bp, Artificial Sequence
  siRNA
uuuuuuuuuuuuuuuuuuutt

SEQ ID NO: 1753 - DNA, 21 bp, Artificial Sequence
  siRNA
gccuggaaauccccucccctt

SEQ ID NO: 1754 - DNA, 21 bp, Artificial Sequence
  siRNA
auccccuccccuucccccutt

SEQ ID NO: 1755 - DNA, 21 bp, Artificial Sequence
  siRNA
ucuggccaugacuagcagatt

SEQ ID NO: 1756 - DNA, 21 bp, Artificial Sequence
  siRNA
gcacagcuaggcccaauggtt

SEQ ID NO: 1757 - DNA, 21 bp, Artificial Sequence
  siRNA
ugggcaaccccaggccagctt

SEQ ID NO: 1758 - DNA, 21 bp, Artificial Sequence
  siRNA
ccccaggccagcaaaauuutt

SEQ ID NO: 1759 - DNA, 21 bp, Artificial Sequence
  siRNA
aauuugccaguucaaauugtt

SEQ ID NO: 1760 - DNA, 21 bp, Artificial Sequence
  siRNA
uuugccaguucaaauuggutt

SEQ ID NO: 1761 - DNA, 21 bp, Artificial Sequence
  siRNA
auugguccugcugggagaatt

SEQ ID NO: 1762 - DNA, 21 bp, Artificial Sequence
  siRNA
ucugcagugggaaagucaatt

SEQ ID NO: 1763 - DNA, 21 bp, Artificial Sequence
  siRNA
agucaagccugguauuacgtt

SEQ ID NO: 1764 - DNA, 21 bp, Artificial Sequence
  siRNA
gccugguauuacguuuugutt

SEQ ID NO: 1765 - DNA, 21 bp, Artificial Sequence
  siRNA
agggcaguuccaugaguactt

SEQ ID NO: 1766 - DNA, 21 bp, Artificial Sequence
  siRNA
cagugaaguuugagaucugtt

SEQ ID NO: 1767 - DNA, 21 bp, Artificial Sequence
  siRNA
guuugagaucugggacacatt

SEQ ID NO: 1768 - DNA, 21 bp, Artificial Sequence
  siRNA
gcugcaaucgugguuuacgtt

SEQ ID NO: 1769 - DNA, 21 bp, Artificial Sequence
  siRNA
ucgugguuuacgacauuactt

SEQ ID NO: 1770 - DNA, 21 bp, Artificial Sequence
  siRNA
ucaggaaaccuuugcccgatt

SEQ ID NO: 1771 - DNA, 21 bp, Artificial Sequence
  siRNA
accuuugcccgagcaaagatt

SEQ ID NO: 1772 - DNA, 21 bp, Artificial Sequence
  siRNA
agacaugggugaaggaacutt

SEQ ID NO: 1773 - DNA, 21 bp, Artificial Sequence
  siRNA
ggaacuacagcgacaggcctt

SEQ ID NO: 1774 - DNA, 21 bp, Artificial Sequence
  siRNA
cuacagcgacaggccaguctt

SEQ ID NO: 1775 - DNA, 21 bp, Artificial Sequence
  siRNA
caaagcugaccuggccaactt

SEQ ID NO: 1776 - DNA, 21 bp, Artificial Sequence
  siRNA
agcugaccuggccaacaaatt

SEQ ID NO: 1777 - DNA, 21 bp, Artificial Sequence
  siRNA
caaacguaugguggaguautt

SEQ ID NO: 1778 - DNA, 21 bp, Artificial Sequence
  siRNA
acguaugguggaguaugaatt

SEQ ID NO: 1779 - DNA, 21 bp, Artificial Sequence
  siRNA
gaggcccaggcauaugcagtt

SEQ ID NO: 1780 - DNA, 21 bp, Artificial Sequence
  siRNA
cagcuuauuguucauggagtt

SEQ ID NO: 1781 - DNA, 21 bp, Artificial Sequence
  siRNA
gacagcuaugaacgugaautt

SEQ ID NO: 1782 - DNA, 21 bp, Artificial Sequence
  siRNA
cgugaaugaucucuuccugtt

SEQ ID NO: 1783 - DNA, 21 bp, Artificial Sequence
  siRNA
ugaucucuuccuggcaauatt

SEQ ID NO: 1784 - DNA, 21 bp, Artificial Sequence
  siRNA
uagcuaagaaguugccaaatt

SEQ ID NO: 1785 - DNA, 21 bp, Artificial Sequence
  siRNA
gaaguugccaaagagugaatt

SEQ ID NO: 1786 - DNA, 21 bp, Artificial Sequence
  siRNA
guugccaaagagugaaccctt

SEQ ID NO: 1787 - DNA, 21 bp, Artificial Sequence
  siRNA
agagugaaccccagaaucutt

SEQ ID NO: 1788 - DNA, 21 bp, Artificial Sequence
  siRNA
ccccagaaucugggaggugtt

SEQ ID NO: 1789 - DNA, 21 bp, Artificial Sequence
  siRNA
ucugggaggugcagcaggctt

SEQ ID NO: 1790 - DNA, 21 bp, Artificial Sequence
  siRNA
gccgggguguggaucuccatt

SEQ ID NO: 1791 - DNA, 21 bp, Artificial Sequence
  siRNA
cagucccagcagaacaagatt

SEQ ID NO: 1792 - DNA, 21 bp, Artificial Sequence
  siRNA
caagagccaguguuguagctt

SEQ ID NO: 1793 - DNA, 21 bp, Artificial Sequence
  siRNA
gagccaguguuguagcaactt

SEQ ID NO: 1794 - DNA, 21 bp, Artificial Sequence
  siRNA
cugaggggguggcuagcagtt

SEQ ID NO: 1795 - DNA, 21 bp, Artificial Sequence
  siRNA
acaaguauggagcuagcactt

SEQ ID NO: 1796 - DNA, 21 bp, Artificial Sequence
  siRNA
guauggagcuagcacaagatt

SEQ ID NO: 1797 - DNA, 21 bp, Artificial Sequence
  siRNA
gagcuaagaaauaaccucctt

SEQ ID NO: 1798 - DNA, 21 bp, Artificial Sequence
  siRNA
gaaauaaccuccaucccuatt

SEQ ID NO: 1799 - DNA, 21 bp, Artificial Sequence
  siRNA
auaaccuccaucccuaccctt

SEQ ID NO: 1800 - DNA, 21 bp, Artificial Sequence
  siRNA
ccuccaucccuaccccucatt

SEQ ID NO: 1801 - DNA, 21 bp, Artificial Sequence
  siRNA
ccccuacgguaacagcacatt

SEQ ID NO: 1802 - DNA, 21 bp, Artificial Sequence
  siRNA
cagcacacugagcccuggctt

SEQ ID NO: 1803 - DNA, 21 bp, Artificial Sequence
  siRNA
gggcugccuccugacagcutt

SEQ ID NO: 1804 - DNA, 21 bp, Artificial Sequence
  siRNA
cgcuucagcaacaaacacctt

SEQ ID NO: 1805 - DNA, 21 bp, Artificial Sequence
  siRNA
caaacaccaggcagcuguutt

SEQ ID NO: 1806 - DNA, 21 bp, Artificial Sequence
  siRNA
acaccaggcagcuguugcctt

SEQ ID NO: 1807 - DNA, 21 bp, Artificial Sequence
  siRNA
cuccccccaggacuuaccutt

SEQ ID NO: 1808 - DNA, 21 bp, Artificial Sequence
  siRNA
aacaaacuuucuucacuuutt

SEQ ID NO: 1809 - DNA, 21 bp, Artificial Sequence
  siRNA
caaacuuucuucacuuugutt

SEQ ID NO: 1810 - DNA, 21 bp, Artificial Sequence
  siRNA
acuuucuucacuuuguauutt

SEQ ID NO: 1811 - DNA, 21 bp, Artificial Sequence
  siRNA
gacagcgacuuacguaucutt

SEQ ID NO: 1812 - DNA, 21 bp, Artificial Sequence
  siRNA
aacacuucugacuccuguctt

SEQ ID NO: 1813 - DNA, 21 bp, Artificial Sequence
  siRNA
cacuucugacuccuguccctt

SEQ ID NO: 1814 - DNA, 21 bp, Artificial Sequence
  siRNA
aguggugaacccaggaacutt

SEQ ID NO: 1815 - DNA, 21 bp, Artificial Sequence
  siRNA
cccaggaacugaggaaggatt

SEQ ID NO: 1816 - DNA, 21 bp, Artificial Sequence
  siRNA
cugaggaaggagguuuccatt

SEQ ID NO: 1817 - DNA, 21 bp, Artificial Sequence
  siRNA
ggagguuuccaguucauuutt

SEQ ID NO: 1818 - DNA, 21 bp, Artificial Sequence
  siRNA
gggcccugggggagaauaatt

SEQ ID NO: 1819 - DNA, 21 bp, Artificial Sequence
  siRNA
uaaagcucagagcaggaggtt

SEQ ID NO: 1820 - DNA, 21 bp, Artificial Sequence
  siRNA
agcucagagcaggagggagtt

SEQ ID NO: 1821 - DNA, 21 bp, Artificial Sequence
  siRNA
ggaaacauuuccuuuuugutt

SEQ ID NO: 1822 - DNA, 21 bp, Artificial Sequence
  siRNA
acauuuccuuuuuguuuuutt

SEQ ID NO: 1823 - DNA, 21 bp, Artificial Sequence
  siRNA
aacauugcgguauccaugatt

SEQ ID NO: 1824 - DNA, 21 bp, Artificial Sequence
  siRNA
cauugcgguauccaugauutt

SEQ ID NO: 1825 - DNA, 21 bp, Artificial Sequence
  siRNA
uggggaggcaagaucucagtt

SEQ ID NO: 1826 - DNA, 21 bp, Artificial Sequence
  siRNA
gaucucaggcaccaggcagtt

SEQ ID NO: 1827 - DNA, 21 bp, Artificial Sequence
  siRNA
gcuaacugggcggagguggtt

SEQ ID NO: 1828 - DNA, 21 bp, Artificial Sequence
  siRNA
cugggcggagguggaggugtt

SEQ ID NO: 1829 - DNA, 21 bp, Artificial Sequence
  siRNA
cuguggcucuguaacucuutt

SEQ ID NO: 1830 - DNA, 21 bp, Artificial Sequence
  siRNA
cucuucaaaggcccaguuutt

SEQ ID NO: 1831 - DNA, 21 bp, Artificial Sequence
  siRNA
aggcccaguuuccccucactt

SEQ ID NO: 1832 - DNA, 21 bp, Artificial Sequence
  siRNA
ucguggggguuggaccccatt

SEQ ID NO: 1833 - DNA, 21 bp, Artificial Sequence
  siRNA
agaauuuucacugguugcctt

SEQ ID NO: 1834 - DNA, 21 bp, Artificial Sequence
  siRNA
uuuucacugguugccugcatt

SEQ ID NO: 1835 - DNA, 21 bp, Artificial Sequence
  siRNA
uugaugguaguucaguuggtt

SEQ ID NO: 1836 - DNA, 21 bp, Artificial Sequence
  siRNA
guuuugauugauuuacuugtt

SEQ ID NO: 1837 - DNA, 21 bp, Artificial Sequence
  siRNA
uucaaugaaaucugagguutt

SEQ ID NO: 1838 - DNA, 21 bp, Artificial Sequence
  siRNA
ugaaaucugagguuaaugctt

SEQ ID NO: 1839 - DNA, 21 bp, Artificial Sequence
  siRNA
aucugagguuaaugcgaggtt

SEQ ID NO: 1840 - DNA, 21 bp, Artificial Sequence
  siRNA
ugcgagguucgaggagaggtt

SEQ ID NO: 1841 - DNA, 21 bp, Artificial Sequence
  siRNA
aacuaccaguggcagcuactt

SEQ ID NO: 1842 - DNA, 21 bp, Artificial Sequence
  siRNA
cuaccaguggcagcuacuctt

SEQ ID NO: 1843 - DNA, 21 bp, Artificial Sequence
  siRNA
guccuaucuccacuguuagtt

SEQ ID NO: 1844 - DNA, 21 bp, Artificial Sequence
  siRNA
cucuaauuauuaaccuauatt

SEQ ID NO: 1845 - DNA, 21 bp, Artificial Sequence
  siRNA
uuauuaaccuauauucuugtt

SEQ ID NO: 1846 - DNA, 21 bp, Artificial Sequence
  siRNA
ccuauauucuugccaagcutt

SEQ ID NO: 1847 - DNA, 21 bp, Artificial Sequence
  siRNA
gcuaacuauugacuauaggtt

SEQ ID NO: 1848 - DNA, 21 bp, Artificial Sequence
  siRNA
cuauugacuauagguuugctt

SEQ ID NO: 1849 - DNA, 21 bp, Artificial Sequence
  siRNA
uuaauugagcaauugaggatt

SEQ ID NO: 1850 - DNA, 21 bp, Artificial Sequence
  siRNA
uugagcaauugaggagugutt

SEQ ID NO: 1851 - DNA, 21 bp, Artificial Sequence
  siRNA
uugaggagugucucaggautt

SEQ ID NO: 1852 - DNA, 21 bp, Artificial Sequence
  siRNA
gguaggggaguaaaaaggatt

SEQ ID NO: 1853 - DNA, 21 bp, Artificial Sequence
  siRNA
aaaggaggucaggcaaaagtt

SEQ ID NO: 1854 - DNA, 21 bp, Artificial Sequence
  siRNA
aggaggucaggcaaaagggtt

SEQ ID NO: 1855 - DNA, 21 bp, Artificial Sequence
  siRNA
aagggaggaguuuucuguctt

SEQ ID NO: 1856 - DNA, 21 bp, Artificial Sequence
  siRNA
gggaggaguuuucuguccutt

SEQ ID NO: 1857 - DNA, 21 bp, Artificial Sequence
  siRNA
uuugauauccauuaccaugtt

SEQ ID NO: 1858 - DNA, 21 bp, Artificial Sequence
  siRNA
auagguaugaucuuuauuctt

SEQ ID NO: 1859 - DNA, 21 bp, Artificial Sequence
  siRNA
uaucuugaauuuagucccutt

SEQ ID NO: 1860 - DNA, 21 bp, Artificial Sequence
  siRNA
uuuagucccuccauccuuatt

SEQ ID NO: 1861 - DNA, 21 bp, Artificial Sequence
  siRNA
uccccccaucccuccccautt

SEQ ID NO: 1862 - DNA, 21 bp, Artificial Sequence
  siRNA
ccagugguuuaauccaugutt

SEQ ID NO: 1863 - DNA, 21 bp, Artificial Sequence
  siRNA
uccauguaccaauaggggctt

SEQ ID NO: 1864 - DNA, 21 bp, Artificial Sequence
  siRNA
uaggggcuaguaccacagatt

SEQ ID NO: 1865 - DNA, 21 bp, Artificial Sequence
  siRNA
ugaccggcacugaagguactt

SEQ ID NO: 1866 - DNA, 21 bp, Artificial Sequence
  siRNA
gguaccuuacaacuggcuctt

SEQ ID NO: 1867 - DNA, 21 bp, Artificial Sequence
  siRNA
cuggcucauauuaucagagtt

SEQ ID NO: 1868 - DNA, 21 bp, Artificial Sequence
  siRNA
aucucuagucucucuucautt

SEQ ID NO: 1869 - DNA, 21 bp, Artificial Sequence
  siRNA
gaugucucugagaagccautt

SEQ ID NO: 1870 - DNA, 21 bp, Artificial Sequence
  siRNA
gccaucaaggcaaaagagatt

SEQ ID NO: 1871 - DNA, 21 bp, Artificial Sequence
  siRNA
ggcaaaagagaacuuuaagtt

SEQ ID NO: 1872 - DNA, 21 bp, Artificial Sequence
  siRNA
aagagaacuuuaaguuccutt

SEQ ID NO: 1873 - DNA, 21 bp, Artificial Sequence
  siRNA
gagaacuuuaaguuccuugtt

SEQ ID NO: 1874 - DNA, 21 bp, Artificial Sequence
  siRNA
cuuuaaguuccuuguuccatt

SEQ ID NO: 1875 - DNA, 21 bp, Artificial Sequence
  siRNA
guuccuuguuccagcccggtt

SEQ ID NO: 1876 - DNA, 21 bp, Artificial Sequence
  siRNA
agaaagaaaggaaaggucatt

SEQ ID NO: 1877 - DNA, 21 bp, Artificial Sequence
  siRNA
agaaaggaaaggucacagutt

SEQ ID NO: 1878 - DNA, 21 bp, Artificial Sequence
  siRNA
aggaaaggucacagugacctt

SEQ ID NO: 1879 - DNA, 21 bp, Artificial Sequence
  siRNA
aggucacagugaccuaggatt

SEQ ID NO: 1880 - DNA, 21 bp, Artificial Sequence
  siRNA
ccuuccugcccuuuuggcutt

SEQ ID NO: 1881 - DNA, 21 bp, Artificial Sequence
  siRNA
cagcugagaaaucuaugaatt

SEQ ID NO: 1882 - DNA, 21 bp, Artificial Sequence
  siRNA
aucuaugaagcugagauuctt

SEQ ID NO: 1883 - DNA, 21 bp, Artificial Sequence
  siRNA
gcugagauucugaaggacctt

SEQ ID NO: 1884 - DNA, 21 bp, Artificial Sequence
  siRNA
ggacccagcuuagguucuutt

SEQ ID NO: 1885 - DNA, 21 bp, Artificial Sequence
  siRNA
uucccuuccuuuuccagggtt

SEQ ID NO: 1886 - DNA, 21 bp, Artificial Sequence
  siRNA
acacacacauuucccccuutt

SEQ ID NO: 1887 - DNA, 21 bp, Artificial Sequence
  siRNA
gccacuggccccccauagctt

SEQ ID NO: 1888 - DNA, 21 bp, Artificial Sequence
  siRNA
guggaagaacuaggauggctt

SEQ ID NO: 1889 - DNA, 21 bp, Artificial Sequence
  siRNA
gaacuaggauggcuuuccatt

SEQ ID NO: 1890 - DNA, 21 bp, Artificial Sequence
  siRNA
cuaggauggcuuuccaaagtt

SEQ ID NO: 1891 - DNA, 21 bp, Artificial Sequence
  siRNA
agucuucuagaaaugaagutt

SEQ ID NO: 1892 - DNA, 21 bp, Artificial Sequence
  siRNA
augaaguucuuucucugugtt

SEQ ID NO: 1893 - DNA, 21 bp, Artificial Sequence
  siRNA
guucuuucucugugcagcutt

SEQ ID NO: 1894 - DNA, 21 bp, Artificial Sequence
  siRNA
gauguuucauuaucuugggtt

SEQ ID NO: 1895 - DNA, 21 bp, Artificial Sequence
  siRNA
accacuuccccaggcuucutt

SEQ ID NO: 1896 - DNA, 21 bp, Artificial Sequence
  siRNA
caggauuuggccuuagcuutt

SEQ ID NO: 1897 - DNA, 21 bp, Artificial Sequence
  siRNA
ggggggguguugugguuuutt

SEQ ID NO: 1898 - DNA, 21 bp, Artificial Sequence
  siRNA
agcauuugccuuucuuccutt

SEQ ID NO: 1899 - DNA, 21 bp, Artificial Sequence
  siRNA
cauaacaaucgugguaacatt

SEQ ID NO: 1900 - DNA, 21 bp, Artificial Sequence
  siRNA
caaucgugguaacagaaugtt

SEQ ID NO: 1901 - DNA, 21 bp, Artificial Sequence
  siRNA
ucgugguaacagaaugcgatt

SEQ ID NO: 1902 - DNA, 21 bp, Artificial Sequence
  siRNA
cagaaugcgacugcugauutt

SEQ ID NO: 1903 - DNA, 21 bp, Artificial Sequence
  siRNA
ugcgacugcugauuuaccgtt

SEQ ID NO: 1904 - DNA, 21 bp, Artificial Sequence
  siRNA
uguaaguaaaaaaaggaaatt

SEQ ID NO: 1905 - DNA, 21 bp, Artificial Sequence
  siRNA
guaaaaaaaggaaaaaaagtt

SEQ ID NO: 1906 - DNA, 21 bp, Artificial Sequence
  siRNA
aaaaaggaaaaaaagaaaatt

SEQ ID NO: 1907 - DNA, 21 bp, Artificial Sequence
  siRNA
aaaggaaaaaaagaaaaaatt

SEQ ID NO: 1908 - DNA, 21 bp, Artificial Sequence
  siRNA
aggaaaaaaagaaaaaaaatt

SEQ ID NO: 1909 - DNA, 21 bp, Artificial Sequence
  siRNA
aaaaagaaaaaaaaaaaaatt

SEQ ID NO: 1910 - DNA, 21 bp, Artificial Sequence
  siRNA
aaagaaaaaaaaaaaaaaatt

SEQ ID NO: 1911 - DNA, 21 bp, Artificial Sequence
  siRNA
agaaaaaaaaaaaaaaaaatt

SEQ ID NO: 1912 - DNA, 21 bp, Artificial Sequence
  siRNA
aaaaaaaaaaaaaaaaaaatt

SEQ ID NO: 1913 - DNA, 21 bp, Artificial Sequence
  siRNA
uggcggaagaaaaucgaggtt

SEQ ID NO: 1914 - DNA, 21 bp, Artificial Sequence
  siRNA
aaagugcacaugggacuautt

SEQ ID NO: 1915 - DNA, 21 bp, Artificial Sequence
  siRNA
augcguuccuaguguuuautt

SEQ ID NO: 1916 - DNA, 21 bp, Artificial Sequence
  siRNA
ggaaaugcguuccuagugutt

SEQ ID NO: 1917 - DNA, 21 bp, Artificial Sequence
  siRNA
aaucuaggguggaaaugcgtt

SEQ ID NO: 1918 - DNA, 21 bp, Artificial Sequence
  siRNA
auuccuuuacauucagcautt

SEQ ID NO: 1919 - DNA, 21 bp, Artificial Sequence
  siRNA
acucaaauauuccuuuacatt

SEQ ID NO: 1920 - DNA, 21 bp, Artificial Sequence
  siRNA
acuuuacucaaauauuccutt

SEQ ID NO: 1921 - DNA, 21 bp, Artificial Sequence
  siRNA
aacucacuuuacucaaauatt

SEQ ID NO: 1922 - DNA, 21 bp, Artificial Sequence
  siRNA
ucaagaacggcaacucacutt

SEQ ID NO: 1923 - DNA, 21 bp, Artificial Sequence
  siRNA
gaauccuuaggagacgggctt

SEQ ID NO: 1924 - DNA, 21 bp, Artificial Sequence
  siRNA
gcggacaccgggagaaucctt

SEQ ID NO: 1925 - DNA, 21 bp, Artificial Sequence
  siRNA
ccuucuuuucuuugucauctt

SEQ ID NO: 1926 - DNA, 21 bp, Artificial Sequence
  siRNA
ccauuguuccuucuuuucutt

SEQ ID NO: 1927 - DNA, 21 bp, Artificial Sequence
  siRNA
acgaccauuguuccuucuutt

SEQ ID NO: 1928 - DNA, 21 bp, Artificial Sequence
  siRNA
gcacgaccauuguuccuuctt

SEQ ID NO: 1929 - DNA, 21 bp, Artificial Sequence
  siRNA
uuggcacgaccauuguucctt

SEQ ID NO: 1930 - DNA, 21 bp, Artificial Sequence
  siRNA
cuuuuuggcacgaccauugtt

SEQ ID NO: 1931 - DNA, 21 bp, Artificial Sequence
  siRNA
gcccuuuuuggcacgaccatt

SEQ ID NO: 1932 - DNA, 21 bp, Artificial Sequence
  siRNA
cacguggccgcggcccuuutt

SEQ ID NO: 1933 - DNA, 21 bp, Artificial Sequence
  siRNA
ugcacguggccgcggcccutt

SEQ ID NO: 1934 - DNA, 21 bp, Artificial Sequence
  siRNA
gggcacgcaucgggcacagtt

SEQ ID NO: 1935 - DNA, 21 bp, Artificial Sequence
  siRNA
uuucuuaauggccuugucctt

SEQ ID NO: 1936 - DNA, 21 bp, Artificial Sequence
  siRNA
gacgaauuucuuaauggcctt

SEQ ID NO: 1937 - DNA, 21 bp, Artificial Sequence
  siRNA
guuucgaaugacgaauuuctt

SEQ ID NO: 1938 - DNA, 21 bp, Artificial Sequence
  siRNA
uauguuucgaaugacgaautt

SEQ ID NO: 1939 - DNA, 21 bp, Artificial Sequence
  siRNA
gcugcggccuccacuaugutt

SEQ ID NO: 1940 - DNA, 21 bp, Artificial Sequence
  siRNA
aggcaucgaagacgcucgctt

SEQ ID NO: 1941 - DNA, 21 bp, Artificial Sequence
  siRNA
auguagcuucacauacagctt

SEQ ID NO: 1942 - DNA, 21 bp, Artificial Sequence
  siRNA
acucacacaguaauguagctt

SEQ ID NO: 1943 - DNA, 21 bp, Artificial Sequence
  siRNA
cugacuacuuugcugugaatt

SEQ ID NO: 1944 - DNA, 21 bp, Artificial Sequence
  siRNA
agaucgauuccugacuacutt

SEQ ID NO: 1945 - DNA, 21 bp, Artificial Sequence
  siRNA
gcgggcuucacgagaucgatt

SEQ ID NO: 1946 - DNA, 21 bp, Artificial Sequence
  siRNA
guguucgguccuugcgggctt

SEQ ID NO: 1947 - DNA, 21 bp, Artificial Sequence
  siRNA
ggguggggguguucggucctt

SEQ ID NO: 1948 - DNA, 21 bp, Artificial Sequence
  siRNA
cuaaaucggggugggggugtt

SEQ ID NO: 1949 - DNA, 21 bp, Artificial Sequence
  siRNA
ucagcuccuuacaugggcutt

SEQ ID NO: 1950 - DNA, 21 bp, Artificial Sequence
  siRNA
ucuuuaagaacucagcucctt

SEQ ID NO: 1951 - DNA, 21 bp, Artificial Sequence
  siRNA
aauagccugucuucagucutt

SEQ ID NO: 1952 - DNA, 21 bp, Artificial Sequence
  siRNA
cuccagagaauagccuguctt

SEQ ID NO: 1953 - DNA, 21 bp, Artificial Sequence
  siRNA
uacaauuuccauuuuauuutt

SEQ ID NO: 1954 - DNA, 21 bp, Artificial Sequence
  siRNA
aguacaauuuccauuuuautt

SEQ ID NO: 1955 - DNA, 21 bp, Artificial Sequence
  siRNA
uuuaaguacaauuuccauutt

SEQ ID NO: 1956 - DNA, 21 bp, Artificial Sequence
  siRNA
uuuuuaaguacaauuuccatt

SEQ ID NO: 1957 - DNA, 21 bp, Artificial Sequence
  siRNA
uuuuuuuuuuaaguacaautt

SEQ ID NO: 1958 - DNA, 21 bp, Artificial Sequence
  siRNA
ccucgauuuucuuccgccatt

SEQ ID NO: 1959 - DNA, 21 bp, Artificial Sequence
  siRNA
auagucccaugugcacuuutt

SEQ ID NO: 1960 - DNA, 21 bp, Artificial Sequence
  siRNA
auaaacacuaggaacgcautt

SEQ ID NO: 1961 - DNA, 21 bp, Artificial Sequence
  siRNA
acacuaggaacgcauuucctt

SEQ ID NO: 1962 - DNA, 21 bp, Artificial Sequence
  siRNA
cgcauuuccacccuagauutt

SEQ ID NO: 1963 - DNA, 21 bp, Artificial Sequence
  siRNA
augcugaauguaaaggaautt

SEQ ID NO: 1964 - DNA, 21 bp, Artificial Sequence
  siRNA
uguaaaggaauauuugagutt

SEQ ID NO: 1965 - DNA, 21 bp, Artificial Sequence
  siRNA
aggaauauuugaguaaagutt

SEQ ID NO: 1966 - DNA, 21 bp, Artificial Sequence
  siRNA
uauuugaguaaagugaguutt

SEQ ID NO: 1967 - DNA, 21 bp, Artificial Sequence
  siRNA
agugaguugccguucuugatt

SEQ ID NO: 1968 - DNA, 21 bp, Artificial Sequence
  siRNA
gcccgucuccuaaggauuctt

SEQ ID NO: 1969 - DNA, 21 bp, Artificial Sequence
  siRNA
ggauucucccgguguccgctt

SEQ ID NO: 1970 - DNA, 21 bp, Artificial Sequence
  siRNA
gaugacaaagaaaagaaggtt

SEQ ID NO: 1971 - DNA, 21 bp, Artificial Sequence
  siRNA
agaaaagaaggaacaauggtt

SEQ ID NO: 1972 - DNA, 21 bp, Artificial Sequence
  siRNA
aagaaggaacaauggucgutt

SEQ ID NO: 1973 - DNA, 21 bp, Artificial Sequence
  siRNA
gaaggaacaauggucgugctt

SEQ ID NO: 1974 - DNA, 21 bp, Artificial Sequence
  siRNA
ggaacaauggucgugccaatt

SEQ ID NO: 1975 - DNA, 21 bp, Artificial Sequence
  siRNA
caauggucgugccaaaaagtt

SEQ ID NO: 1976 - DNA, 21 bp, Artificial Sequence
  siRNA
uggucgugccaaaaagggctt

SEQ ID NO: 1977 - DNA, 21 bp, Artificial Sequence
  siRNA
aaagggccgcggccacgugtt

SEQ ID NO: 1978 - DNA, 21 bp, Artificial Sequence
  siRNA
agggccgcggccacgugcatt

SEQ ID NO: 1979 - DNA, 21 bp, Artificial Sequence
  siRNA
cugugcccgaugcgugccctt

SEQ ID NO: 1980 - DNA, 21 bp, Artificial Sequence
  siRNA
ggacaaggccauuaagaaatt

SEQ ID NO: 1981 - DNA, 21 bp, Artificial Sequence
  siRNA
ggccauuaagaaauucguctt

SEQ ID NO: 1982 - DNA, 21 bp, Artificial Sequence
  siRNA
gaaauucgucauucgaaactt

SEQ ID NO: 1983 - DNA, 21 bp, Artificial Sequence
  siRNA
auucgucauucgaaacauatt

SEQ ID NO: 1984 - DNA, 21 bp, Artificial Sequence
  siRNA
acauaguggaggccgcagctt

SEQ ID NO: 1985 - DNA, 21 bp, Artificial Sequence
  siRNA
gcgagcgucuucgaugccutt

SEQ ID NO: 1986 - DNA, 21 bp, Artificial Sequence
  siRNA
gcuguaugugaagcuacautt

SEQ ID NO: 1987 - DNA, 21 bp, Artificial Sequence
  siRNA
gcuacauuacugugugagutt

SEQ ID NO: 1988 - DNA, 21 bp, Artificial Sequence
  siRNA
uucacagcaaaguagucagtt

SEQ ID NO: 1989 - DNA, 21 bp, Artificial Sequence
  siRNA
aguagucaggaaucgaucutt

SEQ ID NO: 1990 - DNA, 21 bp, Artificial Sequence
  siRNA
ucgaucucgugaagcccgctt

SEQ ID NO: 1991 - DNA, 21 bp, Artificial Sequence
  siRNA
gcccgcaaggaccgaacactt

SEQ ID NO: 1992 - DNA, 21 bp, Artificial Sequence
  siRNA
ggaccgaacacccccaccctt

SEQ ID NO: 1993 - DNA, 21 bp, Artificial Sequence
  siRNA
cacccccaccccgauuuagtt

SEQ ID NO: 1994 - DNA, 21 bp, Artificial Sequence
  siRNA
agcccauguaaggagcugatt

SEQ ID NO: 1995 - DNA, 21 bp, Artificial Sequence
  siRNA
ggagcugaguucuuaaagatt

SEQ ID NO: 1996 - DNA, 21 bp, Artificial Sequence
  siRNA
agacugaagacaggcuauutt

SEQ ID NO: 1997 - DNA, 21 bp, Artificial Sequence
  siRNA
gacaggcuauucucuggagtt

SEQ ID NO: 1998 - DNA, 21 bp, Artificial Sequence
  siRNA
aaauaaaauggaaauuguatt

SEQ ID NO: 1999 - DNA, 21 bp, Artificial Sequence
  siRNA
auaaaauggaaauuguacutt

SEQ ID NO: 2000 - DNA, 21 bp, Artificial Sequence
  siRNA
aauggaaauuguacuuaaatt

SEQ ID NO: 2001 - DNA, 21 bp, Artificial Sequence
  siRNA
uggaaauuguacuuaaaaatt

SEQ ID NO: 2002 - DNA, 21 bp, Artificial Sequence
  siRNA
auuguacuuaaaaaaaaaatt

SEQ ID NO: 2003 - DNA, 21 bp, Artificial Sequence
  siRNA
aggggcggggccagcgccgtt

SEQ ID NO: 2004 - DNA, 21 bp, Artificial Sequence
  siRNA
accagcccagcucugcgagtt

SEQ ID NO: 2005 - DNA, 21 bp, Artificial Sequence
  siRNA
ugucuucagcacugcaauutt

SEQ ID NO: 2006 - DNA, 21 bp, Artificial Sequence
  siRNA
agugucuucagcacugcaatt

SEQ ID NO: 2007 - DNA, 21 bp, Artificial Sequence
  siRNA
cuuuugcggguccaguguctt

SEQ ID NO: 2008 - DNA, 21 bp, Artificial Sequence
  siRNA
guuugggagggacagccuutt

SEQ ID NO: 2009 - DNA, 21 bp, Artificial Sequence
  siRNA
agguuugggagggacagcctt

SEQ ID NO: 2010 - DNA, 21 bp, Artificial Sequence
  siRNA
ugagcccagaaucccaggutt

SEQ ID NO: 2011 - DNA, 21 bp, Artificial Sequence
  siRNA
cucaaugccagcagccugutt

SEQ ID NO: 2012 - DNA, 21 bp, Artificial Sequence
  siRNA
gacugcuagaggccaggagtt

SEQ ID NO: 2013 - DNA, 21 bp, Artificial Sequence
  siRNA
uuccggacacacuagcacutt

SEQ ID NO: 2014 - DNA, 21 bp, Artificial Sequence
  siRNA
gagaccaagaacccaccaatt

SEQ ID NO: 2015 - DNA, 21 bp, Artificial Sequence
  siRNA
aggguccgcggcuucauuctt

SEQ ID NO: 2016 - DNA, 21 bp, Artificial Sequence
  siRNA
gcgaggguccgcggcuucatt

SEQ ID NO: 2017 - DNA, 21 bp, Artificial Sequence
  siRNA
gacugcgaggguccgcggctt

SEQ ID NO: 2018 - DNA, 21 bp, Artificial Sequence
  siRNA
gcucugugcagcagcagcatt

SEQ ID NO: 2019 - DNA, 21 bp, Artificial Sequence
  siRNA
acuugagucugcaggccugtt

SEQ ID NO: 2020 - DNA, 21 bp, Artificial Sequence
  siRNA
gauccuugaggggauugactt

SEQ ID NO: 2021 - DNA, 21 bp, Artificial Sequence
  siRNA
augcagauccuugaggggatt

SEQ ID NO: 2022 - DNA, 21 bp, Artificial Sequence
  siRNA
caggccugaaugcagaucctt

SEQ ID NO: 2023 - DNA, 21 bp, Artificial Sequence
  siRNA
uggggcugaaaugaaucautt

SEQ ID NO: 2024 - DNA, 21 bp, Artificial Sequence
  siRNA
ccaucccugggugcuggagtt

SEQ ID NO: 2025 - DNA, 21 bp, Artificial Sequence
  siRNA
uccuuaguguauaugugugtt

SEQ ID NO: 2026 - DNA, 21 bp, Artificial Sequence
  siRNA
gugggaacucacuuccucctt

SEQ ID NO: 2027 - DNA, 21 bp, Artificial Sequence
  siRNA
ggcuggugugggaacucactt

SEQ ID NO: 2028 - DNA, 21 bp, Artificial Sequence
  siRNA
cuggauguagguccacaaatt

SEQ ID NO: 2029 - DNA, 21 bp, Artificial Sequence
  siRNA
ccagcugcuagcaucagcutt

SEQ ID NO: 2030 - DNA, 21 bp, Artificial Sequence
  siRNA
cucacgcacaugggacuggtt

SEQ ID NO: 2031 - DNA, 21 bp, Artificial Sequence
  siRNA
aggauucagcuccccaauctt

SEQ ID NO: 2032 - DNA, 21 bp, Artificial Sequence
  siRNA
ggcuaccuugucuucaggatt

SEQ ID NO: 2033 - DNA, 21 bp, Artificial Sequence
  siRNA
cggugggggcuaccuuguctt

SEQ ID NO: 2034 - DNA, 21 bp, Artificial Sequence
  siRNA
cuccacggugggggcuacctt

SEQ ID NO: 2035 - DNA, 21 bp, Artificial Sequence
  siRNA
gggccgcuggcuguugacctt

SEQ ID NO: 2036 - DNA, 21 bp, Artificial Sequence
  siRNA
auuaaagggccgcuggcugtt

SEQ ID NO: 2037 - DNA, 21 bp, Artificial Sequence
  siRNA
cucagggggaggcucugcatt

SEQ ID NO: 2038 - DNA, 21 bp, Artificial Sequence
  siRNA
gguugggugugauguaguutt

SEQ ID NO: 2039 - DNA, 21 bp, Artificial Sequence
  siRNA
aggguugggugugauguagtt

SEQ ID NO: 2040 - DNA, 21 bp, Artificial Sequence
  siRNA
ccgggugaagaagauagggtt

SEQ ID NO: 2041 - DNA, 21 bp, Artificial Sequence
  siRNA
guuagguacaggcagauggtt

SEQ ID NO: 2042 - DNA, 21 bp, Artificial Sequence
  siRNA
auaggugucuggauccaggtt

SEQ ID NO: 2043 - DNA, 21 bp, Artificial Sequence
  siRNA
gaucucguaccugggaaagtt

SEQ ID NO: 2044 - DNA, 21 bp, Artificial Sequence
  siRNA
agucaucucagagcgucggtt

SEQ ID NO: 2045 - DNA, 21 bp, Artificial Sequence
  siRNA
cuccagaccuuuuacuucutt

SEQ ID NO: 2046 - DNA, 21 bp, Artificial Sequence
  siRNA
uccacuccagaccuuuuactt

SEQ ID NO: 2047 - DNA, 21 bp, Artificial Sequence
  siRNA
guucuccacuccagaccuutt

SEQ ID NO: 2048 - DNA, 21 bp, Artificial Sequence
  siRNA
cuguucuccacuccagacctt

SEQ ID NO: 2049 - DNA, 21 bp, Artificial Sequence
  siRNA
gcagugcugauggcuccugtt

SEQ ID NO: 2050 - DNA, 21 bp, Artificial Sequence
  siRNA
gggccucaguuucacagagtt

SEQ ID NO: 2051 - DNA, 21 bp, Artificial Sequence
  siRNA
agcagacgugggccucagutt

SEQ ID NO: 2052 - DNA, 21 bp, Artificial Sequence
  siRNA
augccagcaggaccucagctt

SEQ ID NO: 2053 - DNA, 21 bp, Artificial Sequence
  siRNA
acguggcagaggcugcccatt

SEQ ID NO: 2054 - DNA, 21 bp, Artificial Sequence
  siRNA
acucacucugcccagccautt

SEQ ID NO: 2055 - DNA, 21 bp, Artificial Sequence
  siRNA
guugccaguggcuguaacutt

SEQ ID NO: 2056 - DNA, 21 bp, Artificial Sequence
  siRNA
agccuuuguaaucccgccgtt

SEQ ID NO: 2057 - DNA, 21 bp, Artificial Sequence
  siRNA
cacagauggagagaagccutt

SEQ ID NO: 2058 - DNA, 21 bp, Artificial Sequence
  siRNA
uggccgacuggacaggaagtt

SEQ ID NO: 2059 - DNA, 21 bp, Artificial Sequence
  siRNA
ugauggucaccuccccugatt

SEQ ID NO: 2060 - DNA, 21 bp, Artificial Sequence
  siRNA
accacuccaugcauagccctt

SEQ ID NO: 2061 - DNA, 21 bp, Artificial Sequence
  siRNA
agcuuagccaccugccaggtt

SEQ ID NO: 2062 - DNA, 21 bp, Artificial Sequence
  siRNA
cuguuccucuccauccagctt

SEQ ID NO: 2063 - DNA, 21 bp, Artificial Sequence
  siRNA
aggccuuccuggggcgcugtt

SEQ ID NO: 2064 - DNA, 21 bp, Artificial Sequence
  siRNA
cagacgccaugcccaggcctt

SEQ ID NO: 2065 - DNA, 21 bp, Artificial Sequence
  siRNA
uccagcuggcacaggggcutt

SEQ ID NO: 2066 - DNA, 21 bp, Artificial Sequence
  siRNA
aaacaauguucaguuccuutt

SEQ ID NO: 2067 - DNA, 21 bp, Artificial Sequence
  siRNA
acaaacaauguucaguucctt

SEQ ID NO: 2068 - DNA, 21 bp, Artificial Sequence
  siRNA
ccuuacaaacaauguucagtt

SEQ ID NO: 2069 - DNA, 21 bp, Artificial Sequence
  siRNA
cacagccuuacaaacaaugtt

SEQ ID NO: 2070 - DNA, 21 bp, Artificial Sequence
  siRNA
guaaccaucauccacagcctt

SEQ ID NO: 2071 - DNA, 21 bp, Artificial Sequence
  siRNA
cacggugucuggcugcacatt

SEQ ID NO: 2072 - DNA, 21 bp, Artificial Sequence
  siRNA
acaccucgcagguuccagatt

SEQ ID NO: 2073 - DNA, 21 bp, Artificial Sequence
  siRNA
gcugagaacaccucgcaggtt

SEQ ID NO: 2074 - DNA, 21 bp, Artificial Sequence
  siRNA
auggacacgaugccaggcatt

SEQ ID NO: 2075 - DNA, 21 bp, Artificial Sequence
  siRNA
agggguggagguggcuccutt

SEQ ID NO: 2076 - DNA, 21 bp, Artificial Sequence
  siRNA
ugaaaggugggaaagauuutt

SEQ ID NO: 2077 - DNA, 21 bp, Artificial Sequence
  siRNA
guugaaaggugggaaagautt

SEQ ID NO: 2078 - DNA, 21 bp, Artificial Sequence
  siRNA
agaguugugauccaagaagtt

SEQ ID NO: 2079 - DNA, 21 bp, Artificial Sequence
  siRNA
uggcuuaggaaggccagagtt

SEQ ID NO: 2080 - DNA, 21 bp, Artificial Sequence
  siRNA
auguguacuuggguauggctt

SEQ ID NO: 2081 - DNA, 21 bp, Artificial Sequence
  siRNA
aaaugugcuauauguguactt

SEQ ID NO: 2082 - DNA, 21 bp, Artificial Sequence
  siRNA
guccaaagagggaaggucctt

SEQ ID NO: 2083 - DNA, 21 bp, Artificial Sequence
  siRNA
ucacacuuccuggcacaggtt

SEQ ID NO: 2084 - DNA, 21 bp, Artificial Sequence
  siRNA
uugcuguaacagcucacactt

SEQ ID NO: 2085 - DNA, 21 bp, Artificial Sequence
  siRNA
uuuuuucacuucuagcccctt

SEQ ID NO: 2086 - DNA, 21 bp, Artificial Sequence
  siRNA
ccagaauuacuuuuuucactt

SEQ ID NO: 2087 - DNA, 21 bp, Artificial Sequence
  siRNA
ugucuccagaauuacuuuutt

SEQ ID NO: 2088 - DNA, 21 bp, Artificial Sequence
  siRNA
cuugucuccagaauuacuutt

SEQ ID NO: 2089 - DNA, 21 bp, Artificial Sequence
  siRNA
ugcuugucuccagaauuactt

SEQ ID NO: 2090 - DNA, 21 bp, Artificial Sequence
  siRNA
auagugcuugucuccagaatt

SEQ ID NO: 2091 - DNA, 21 bp, Artificial Sequence
  siRNA
uaggaagagaaaauagugctt

SEQ ID NO: 2092 - DNA, 21 bp, Artificial Sequence
  siRNA
gccuugauggcaguaggcatt

SEQ ID NO: 2093 - DNA, 21 bp, Artificial Sequence
  siRNA
agaaaagcaaaacaaggcctt

SEQ ID NO: 2094 - DNA, 21 bp, Artificial Sequence
  siRNA
uuacacaugccacacacautt

SEQ ID NO: 2095 - DNA, 21 bp, Artificial Sequence
  siRNA
gauaguauauacacuuuuctt

SEQ ID NO: 2096 - DNA, 21 bp, Artificial Sequence
  siRNA
uaagauaguauauacacuutt

SEQ ID NO: 2097 - DNA, 21 bp, Artificial Sequence
  siRNA
uauaagauaguauauacactt

SEQ ID NO: 2098 - DNA, 21 bp, Artificial Sequence
  siRNA
agggagacgguugugcccctt

SEQ ID NO: 2099 - DNA, 21 bp, Artificial Sequence
  siRNA
gaacuauaaagggagacggtt

SEQ ID NO: 2100 - DNA, 21 bp, Artificial Sequence
  siRNA
aucuuaaacagacuauuuatt

SEQ ID NO: 2101 - DNA, 21 bp, Artificial Sequence
  siRNA
augaucuuaaacagacuautt

SEQ ID NO: 2102 - DNA, 21 bp, Artificial Sequence
  siRNA
uuuuuuuuuuuuuaugauctt

SEQ ID NO: 2103 - DNA, 21 bp, Artificial Sequence
  siRNA
uuuuuuuuuuuuuuuuuuutt

SEQ ID NO: 2104 - DNA, 21 bp, Artificial Sequence
  siRNA
cggcgcuggccccgccccutt

SEQ ID NO: 2105 - DNA, 21 bp, Artificial Sequence
  siRNA
cucgcagagcugggcuggutt

SEQ ID NO: 2106 - DNA, 21 bp, Artificial Sequence
  siRNA
aauugcagugcugaagacatt

SEQ ID NO: 2107 - DNA, 21 bp, Artificial Sequence
  siRNA
uugcagugcugaagacacutt

SEQ ID NO: 2108 - DNA, 21 bp, Artificial Sequence
  siRNA
gacacuggacccgcaaaagtt

SEQ ID NO: 2109 - DNA, 21 bp, Artificial Sequence
  siRNA
aaggcugucccucccaaactt

SEQ ID NO: 2110 - DNA, 21 bp, Artificial Sequence
  siRNA
ggcugucccucccaaaccutt

SEQ ID NO: 2111 - DNA, 21 bp, Artificial Sequence
  siRNA
accugggauucugggcucatt

SEQ ID NO: 2112 - DNA, 21 bp, Artificial Sequence
  siRNA
acaggcugcuggcauugagtt

SEQ ID NO: 2113 - DNA, 21 bp, Artificial Sequence
  siRNA
cuccuggccucuagcaguctt

SEQ ID NO: 2114 - DNA, 21 bp, Artificial Sequence
  siRNA
agugcuaguguguccggaatt

SEQ ID NO: 2115 - DNA, 21 bp, Artificial Sequence
  siRNA
uugguggguucuuggucuctt

SEQ ID NO: 2116 - DNA, 21 bp, Artificial Sequence
  siRNA
gaaugaagccgcggacccutt

SEQ ID NO: 2117 - DNA, 21 bp, Artificial Sequence
  siRNA
ugaagccgcggacccucgctt

SEQ ID NO: 2118 - DNA, 21 bp, Artificial Sequence
  siRNA
gccgcggacccucgcaguctt

SEQ ID NO: 2119 - DNA, 21 bp, Artificial Sequence
  siRNA
ugcugcugcugcacagagctt

SEQ ID NO: 2120 - DNA, 21 bp, Artificial Sequence
  siRNA
caggccugcagacucaagutt

SEQ ID NO: 2121 - DNA, 21 bp, Artificial Sequence
  siRNA
gucaauccccucaaggauctt

SEQ ID NO: 2122 - DNA, 21 bp, Artificial Sequence
  siRNA
uccccucaaggaucugcautt

SEQ ID NO: 2123 - DNA, 21 bp, Artificial Sequence
  siRNA
ggaucugcauucaggccugtt

SEQ ID NO: 2124 - DNA, 21 bp, Artificial Sequence
  siRNA
augauucauuucagccccatt

SEQ ID NO: 2125 - DNA, 21 bp, Artificial Sequence
  siRNA
cuccagcacccagggauggtt

SEQ ID NO: 2126 - DNA, 21 bp, Artificial Sequence
  siRNA
cacacauauacacuaaggatt

SEQ ID NO: 2127 - DNA, 21 bp, Artificial Sequence
  siRNA
ggaggaagugaguucccactt

SEQ ID NO: 2128 - DNA, 21 bp, Artificial Sequence
  siRNA
gugaguucccacaccagcctt

SEQ ID NO: 2129 - DNA, 21 bp, Artificial Sequence
  siRNA
uuuguggaccuacauccagtt

SEQ ID NO: 2130 - DNA, 21 bp, Artificial Sequence
  siRNA
agcugaugcuagcagcuggtt

SEQ ID NO: 2131 - DNA, 21 bp, Artificial Sequence
  siRNA
ccagucccaugugcgugagtt

SEQ ID NO: 2132 - DNA, 21 bp, Artificial Sequence
  siRNA
gauuggggagcugaauccutt

SEQ ID NO: 2133 - DNA, 21 bp, Artificial Sequence
  siRNA
uccugaagacaagguagcctt

SEQ ID NO: 2134 - DNA, 21 bp, Artificial Sequence
  siRNA
gacaagguagcccccaccgtt

SEQ ID NO: 2135 - DNA, 21 bp, Artificial Sequence
  siRNA
gguagcccccaccguggagtt

SEQ ID NO: 2136 - DNA, 21 bp, Artificial Sequence
  siRNA
ggucaacagccagcggccctt

SEQ ID NO: 2137 - DNA, 21 bp, Artificial Sequence
  siRNA
cagccagcggcccuuuaautt

SEQ ID NO: 2138 - DNA, 21 bp, Artificial Sequence
  siRNA
ugcagagccucccccugagtt

SEQ ID NO: 2139 - DNA, 21 bp, Artificial Sequence
  siRNA
aacuacaucacacccaacctt

SEQ ID NO: 2140 - DNA, 21 bp, Artificial Sequence
  siRNA
cuacaucacacccaacccutt

SEQ ID NO: 2141 - DNA, 21 bp, Artificial Sequence
  siRNA
cccuaucuucuucacccggtt

SEQ ID NO: 2142 - DNA, 21 bp, Artificial Sequence
  siRNA
ccaucugccuguaccuaactt

SEQ ID NO: 2143 - DNA, 21 bp, Artificial Sequence
  siRNA
ccuggauccagacaccuautt

SEQ ID NO: 2144 - DNA, 21 bp, Artificial Sequence
  siRNA
cuuucccagguacgagauctt

SEQ ID NO: 2145 - DNA, 21 bp, Artificial Sequence
  siRNA
ccgacgcucugagaugacutt

SEQ ID NO: 2146 - DNA, 21 bp, Artificial Sequence
  siRNA
agaaguaaaaggucuggagtt

SEQ ID NO: 2147 - DNA, 21 bp, Artificial Sequence
  siRNA
guaaaaggucuggaguggatt

SEQ ID NO: 2148 - DNA, 21 bp, Artificial Sequence
  siRNA
aaggucuggaguggagaactt

SEQ ID NO: 2149 - DNA, 21 bp, Artificial Sequence
  siRNA
ggucuggaguggagaacagtt

SEQ ID NO: 2150 - DNA, 21 bp, Artificial Sequence
  siRNA
caggagccaucagcacugctt

SEQ ID NO: 2151 - DNA, 21 bp, Artificial Sequence
  siRNA
cucugugaaacugaggccctt

SEQ ID NO: 2152 - DNA, 21 bp, Artificial Sequence
  siRNA
acugaggcccacgucugcutt

SEQ ID NO: 2153 - DNA, 21 bp, Artificial Sequence
  siRNA
gcugagguccugcuggcautt

SEQ ID NO: 2154 - DNA, 21 bp, Artificial Sequence
  siRNA
ugggcagccucugccacgutt

SEQ ID NO: 2155 - DNA, 21 bp, Artificial Sequence
  siRNA
auggcugggcagagugagutt

SEQ ID NO: 2156 - DNA, 21 bp, Artificial Sequence
  siRNA
aguuacagccacuggcaactt

SEQ ID NO: 2157 - DNA, 21 bp, Artificial Sequence
  siRNA
cggcgggauuacaaaggcutt

SEQ ID NO: 2158 - DNA, 21 bp, Artificial Sequence
  siRNA
aggcuucucuccaucugugtt

SEQ ID NO: 2159 - DNA, 21 bp, Artificial Sequence
  siRNA
cuuccuguccagucggccatt

SEQ ID NO: 2160 - DNA, 21 bp, Artificial Sequence
  siRNA
ucaggggaggugaccaucatt

SEQ ID NO: 2161 - DNA, 21 bp, Artificial Sequence
  siRNA
gggcuaugcauggaguggutt

SEQ ID NO: 2162 - DNA, 21 bp, Artificial Sequence
  siRNA
ccuggcagguggcuaagcutt

SEQ ID NO: 2163 - DNA, 21 bp, Artificial Sequence
  siRNA
gcuggauggagaggaacagtt

SEQ ID NO: 2164 - DNA, 21 bp, Artificial Sequence
  siRNA
cagcgccccaggaaggccutt

SEQ ID NO: 2165 - DNA, 21 bp, Artificial Sequence
  siRNA
ggccugggcauggcgucugtt

SEQ ID NO: 2166 - DNA, 21 bp, Artificial Sequence
  siRNA
agccccugugccagcuggatt

SEQ ID NO: 2167 - DNA, 21 bp, Artificial Sequence
  siRNA
aaggaacugaacauuguuutt

SEQ ID NO: 2168 - DNA, 21 bp, Artificial Sequence
  siRNA
ggaacugaacauuguuugutt

SEQ ID NO: 2169 - DNA, 21 bp, Artificial Sequence
  siRNA
cugaacauuguuuguaaggtt

SEQ ID NO: 2170 - DNA, 21 bp, Artificial Sequence
  siRNA
cauuguuuguaaggcugugtt

SEQ ID NO: 2171 - DNA, 21 bp, Artificial Sequence
  siRNA
ggcuguggaugaugguuactt

SEQ ID NO: 2172 - DNA, 21 bp, Artificial Sequence
  siRNA
ugugcagccagacaccgugtt

SEQ ID NO: 2173 - DNA, 21 bp, Artificial Sequence
  siRNA
ucuggaaccugcgaggugutt

SEQ ID NO: 2174 - DNA, 21 bp, Artificial Sequence
  siRNA
ccugcgagguguucucagctt

SEQ ID NO: 2175 - DNA, 21 bp, Artificial Sequence
  siRNA
ugccuggcaucguguccautt

SEQ ID NO: 2176 - DNA, 21 bp, Artificial Sequence
  siRNA
aggagccaccuccaccccutt

SEQ ID NO: 2177 - DNA, 21 bp, Artificial Sequence
  siRNA
aaaucuuucccaccuuucatt

SEQ ID NO: 2178 - DNA, 21 bp, Artificial Sequence
  siRNA
aucuuucccaccuuucaactt

SEQ ID NO: 2179 - DNA, 21 bp, Artificial Sequence
  siRNA
cuucuuggaucacaacucutt

SEQ ID NO: 2180 - DNA, 21 bp, Artificial Sequence
  siRNA
cucuggccuuccuaagccatt

SEQ ID NO: 2181 - DNA, 21 bp, Artificial Sequence
  siRNA
gccauacccaaguacacautt

SEQ ID NO: 2182 - DNA, 21 bp, Artificial Sequence
  siRNA
guacacauauagcacauuutt

SEQ ID NO: 2183 - DNA, 21 bp, Artificial Sequence
  siRNA
ggaccuucccucuuuggactt

SEQ ID NO: 2184 - DNA, 21 bp, Artificial Sequence
  siRNA
ccugugccaggaagugugatt

SEQ ID NO: 2185 - DNA, 21 bp, Artificial Sequence
  siRNA
gugugagcuguuacagcaatt

SEQ ID NO: 2186 - DNA, 21 bp, Artificial Sequence
  siRNA
ggggcuagaagugaaaaaatt

SEQ ID NO: 2187 - DNA, 21 bp, Artificial Sequence
  siRNA
gugaaaaaaguaauucuggtt

SEQ ID NO: 2188 - DNA, 21 bp, Artificial Sequence
  siRNA
aaaaguaauucuggagacatt

SEQ ID NO: 2189 - DNA, 21 bp, Artificial Sequence
  siRNA
aaguaauucuggagacaagtt

SEQ ID NO: 2190 - DNA, 21 bp, Artificial Sequence
  siRNA
guaauucuggagacaagcatt

SEQ ID NO: 2191 - DNA, 21 bp, Artificial Sequence
  siRNA
uucuggagacaagcacuautt

SEQ ID NO: 2192 - DNA, 21 bp, Artificial Sequence
  siRNA
gcacuauuuucucuuccuatt

SEQ ID NO: 2193 - DNA, 21 bp, Artificial Sequence
  siRNA
ugccuacugccaucaaggctt

SEQ ID NO: 2194 - DNA, 21 bp, Artificial Sequence
  siRNA
ggccuuguuuugcuuuucutt

SEQ ID NO: 2195 - DNA, 21 bp, Artificial Sequence
  siRNA
auguguguggcauguguaatt

SEQ ID NO: 2196 - DNA, 21 bp, Artificial Sequence
  siRNA
gaaaaguguauauacuauctt

SEQ ID NO: 2197 - DNA, 21 bp, Artificial Sequence
  siRNA
aaguguauauacuaucuuatt

SEQ ID NO: 2198 - DNA, 21 bp, Artificial Sequence
  siRNA
guguauauacuaucuuauatt

SEQ ID NO: 2199 - DNA, 21 bp, Artificial Sequence
  siRNA
ggggcacaaccgucucccutt

SEQ ID NO: 2200 - DNA, 21 bp, Artificial Sequence
  siRNA
ccgucucccuuuauaguuctt

SEQ ID NO: 2201 - DNA, 21 bp, Artificial Sequence
  siRNA
uaaauagucuguuuaagautt

SEQ ID NO: 2202 - DNA, 21 bp, Artificial Sequence
  siRNA
auagucuguuuaagaucautt

SEQ ID NO: 2203 - DNA, 21 bp, Artificial Sequence
  siRNA
gaucauaaaaaaaaaaaaatt

SEQ ID NO: 2204 - DNA, 21 bp, Artificial Sequence
  siRNA
aaaaaaaaaaaaaaaaaaatt

SEQ ID NO: 2205 - DNA, 21 bp, Artificial Sequence
  siRNA
aggggcggggccagcgccgtt

SEQ ID NO: 2206 - DNA, 21 bp, Artificial Sequence
  siRNA
accagcccagcucugcgagtt

SEQ ID NO: 2207 - DNA, 21 bp, Artificial Sequence
  siRNA
ugucuucagcacugcaauutt

SEQ ID NO: 2208 - DNA, 21 bp, Artificial Sequence
  siRNA
agugucuucagcacugcaatt

SEQ ID NO: 2209 - DNA, 21 bp, Artificial Sequence
  siRNA
cuuuugcggguccaguguctt

SEQ ID NO: 2210 - DNA, 21 bp, Artificial Sequence
  siRNA
guuugggagggacagccuutt

SEQ ID NO: 2211 - DNA, 21 bp, Artificial Sequence
  siRNA
agguuugggagggacagcctt

SEQ ID NO: 2212 - DNA, 21 bp, Artificial Sequence
  siRNA
ugagcccagaaucccaggutt

SEQ ID NO: 2213 - DNA, 21 bp, Artificial Sequence
  siRNA
cucaaugccagcagccugutt

SEQ ID NO: 2214 - DNA, 21 bp, Artificial Sequence
  siRNA
gcucugugcagcagcagcatt

SEQ ID NO: 2215 - DNA, 21 bp, Artificial Sequence
  siRNA
acuugagucugcaggccugtt

SEQ ID NO: 2216 - DNA, 21 bp, Artificial Sequence
  siRNA
gauccuugaggggauugactt

SEQ ID NO: 2217 - DNA, 21 bp, Artificial Sequence
  siRNA
augcagauccuugaggggatt

SEQ ID NO: 2218 - DNA, 21 bp, Artificial Sequence
  siRNA
caggccugaaugcagaucctt

SEQ ID NO: 2219 - DNA, 21 bp, Artificial Sequence
  siRNA
uggggcugaaaugaaucautt

SEQ ID NO: 2220 - DNA, 21 bp, Artificial Sequence
  siRNA
ccaucccugggugcuggagtt

SEQ ID NO: 2221 - DNA, 21 bp, Artificial Sequence
  siRNA
uccuuaguguauaugugugtt

SEQ ID NO: 2222 - DNA, 21 bp, Artificial Sequence
  siRNA
gugggaacucacuuccucctt

SEQ ID NO: 2223 - DNA, 21 bp, Artificial Sequence
  siRNA
ggcuggugugggaacucactt

SEQ ID NO: 2224 - DNA, 21 bp, Artificial Sequence
  siRNA
cuggauguagguccacaaatt

SEQ ID NO: 2225 - DNA, 21 bp, Artificial Sequence
  siRNA
ccagcugcuagcaucagcutt

SEQ ID NO: 2226 - DNA, 21 bp, Artificial Sequence
  siRNA
cucacgcacaugggacuggtt

SEQ ID NO: 2227 - DNA, 21 bp, Artificial Sequence
  siRNA
aggauucagcuccccaauctt

SEQ ID NO: 2228 - DNA, 21 bp, Artificial Sequence
  siRNA
ggcuaccuugucuucaggatt

SEQ ID NO: 2229 - DNA, 21 bp, Artificial Sequence
  siRNA
cggugggggcuaccuuguctt

SEQ ID NO: 2230 - DNA, 21 bp, Artificial Sequence
  siRNA
cuccacggugggggcuacctt

SEQ ID NO: 2231 - DNA, 21 bp, Artificial Sequence
  siRNA
gggccgcuggcuguugacctt

SEQ ID NO: 2232 - DNA, 21 bp, Artificial Sequence
  siRNA
auuaaagggccgcuggcugtt

SEQ ID NO: 2233 - DNA, 21 bp, Artificial Sequence
  siRNA
cucagggggaggcucugcatt

SEQ ID NO: 2234 - DNA, 21 bp, Artificial Sequence
  siRNA
gguugggugugauguaguutt

SEQ ID NO: 2235 - DNA, 21 bp, Artificial Sequence
  siRNA
aggguugggugugauguagtt

SEQ ID NO: 2236 - DNA, 21 bp, Artificial Sequence
  siRNA
ccgggugaagaagauagggtt

SEQ ID NO: 2237 - DNA, 21 bp, Artificial Sequence
  siRNA
guuagguacaggcagauggtt

SEQ ID NO: 2238 - DNA, 21 bp, Artificial Sequence
  siRNA
auaggugucuggauccaggtt

SEQ ID NO: 2239 - DNA, 21 bp, Artificial Sequence
  siRNA
gaucucguaccugggaaagtt

SEQ ID NO: 2240 - DNA, 21 bp, Artificial Sequence
  siRNA
agucaucucagagcgucggtt

SEQ ID NO: 2241 - DNA, 21 bp, Artificial Sequence
  siRNA
cuccagaccuuuuacuucutt

SEQ ID NO: 2242 - DNA, 21 bp, Artificial Sequence
  siRNA
uccacuccagaccuuuuactt

SEQ ID NO: 2243 - DNA, 21 bp, Artificial Sequence
  siRNA
guucuccacuccagaccuutt

SEQ ID NO: 2244 - DNA, 21 bp, Artificial Sequence
  siRNA
cuguucuccacuccagacctt

SEQ ID NO: 2245 - DNA, 21 bp, Artificial Sequence
  siRNA
gcagugcugauggcuccugtt

SEQ ID NO: 2246 - DNA, 21 bp, Artificial Sequence
  siRNA
gggccucaguuucacagagtt

SEQ ID NO: 2247 - DNA, 21 bp, Artificial Sequence
  siRNA
agcagacgugggccucagutt

SEQ ID NO: 2248 - DNA, 21 bp, Artificial Sequence
  siRNA
augccagcaggaccucagctt

SEQ ID NO: 2249 - DNA, 21 bp, Artificial Sequence
  siRNA
acguggcagaggcugcccatt

SEQ ID NO: 2250 - DNA, 21 bp, Artificial Sequence
  siRNA
acucacucugcccagccautt

SEQ ID NO: 2251 - DNA, 21 bp, Artificial Sequence
  siRNA
guugccaguggcuguaacutt

SEQ ID NO: 2252 - DNA, 21 bp, Artificial Sequence
  siRNA
agccuuuguaaucccgccgtt

SEQ ID NO: 2253 - DNA, 21 bp, Artificial Sequence
  siRNA
cacagauggagagaagccutt

SEQ ID NO: 2254 - DNA, 21 bp, Artificial Sequence
  siRNA
uggccgacuggacaggaagtt

SEQ ID NO: 2255 - DNA, 21 bp, Artificial Sequence
  siRNA
ugauggucaccuccccugatt

SEQ ID NO: 2256 - DNA, 21 bp, Artificial Sequence
  siRNA
accacuccaugcauagccctt

SEQ ID NO: 2257 - DNA, 21 bp, Artificial Sequence
  siRNA
agcuuagccaccugccaggtt

SEQ ID NO: 2258 - DNA, 21 bp, Artificial Sequence
  siRNA
cuguuccucuccauccagctt

SEQ ID NO: 2259 - DNA, 21 bp, Artificial Sequence
  siRNA
aggccuuccuggggcgcugtt

SEQ ID NO: 2260 - DNA, 21 bp, Artificial Sequence
  siRNA
cagacgccaugcccaggcctt

SEQ ID NO: 2261 - DNA, 21 bp, Artificial Sequence
  siRNA
uccagcuggcacaggggcutt

SEQ ID NO: 2262 - DNA, 21 bp, Artificial Sequence
  siRNA
aaacaauguucaguuccuutt

SEQ ID NO: 2263 - DNA, 21 bp, Artificial Sequence
  siRNA
acaaacaauguucaguucctt

SEQ ID NO: 2264 - DNA, 21 bp, Artificial Sequence
  siRNA
ccuuacaaacaauguucagtt

SEQ ID NO: 2265 - DNA, 21 bp, Artificial Sequence
  siRNA
cacagccuuacaaacaaugtt

SEQ ID NO: 2266 - DNA, 21 bp, Artificial Sequence
  siRNA
guaaccaucauccacagcctt

SEQ ID NO: 2267 - DNA, 21 bp, Artificial Sequence
  siRNA
cacggugucuggcugcacatt

SEQ ID NO: 2268 - DNA, 21 bp, Artificial Sequence
  siRNA
acaccucgcagguuccagatt

SEQ ID NO: 2269 - DNA, 21 bp, Artificial Sequence
  siRNA
gcugagaacaccucgcaggtt

SEQ ID NO: 2270 - DNA, 21 bp, Artificial Sequence
  siRNA
auggacacgaugccaggcatt

SEQ ID NO: 2271 - DNA, 21 bp, Artificial Sequence
  siRNA
agggguggagguggcuccutt

SEQ ID NO: 2272 - DNA, 21 bp, Artificial Sequence
  siRNA
ugaaaggugggaaagauuutt

SEQ ID NO: 2273 - DNA, 21 bp, Artificial Sequence
  siRNA
guugaaaggugggaaagautt

SEQ ID NO: 2274 - DNA, 21 bp, Artificial Sequence
  siRNA
agaguugugauccaagaagtt

SEQ ID NO: 2275 - DNA, 21 bp, Artificial Sequence
  siRNA
uggcuuaggaaggccagagtt

SEQ ID NO: 2276 - DNA, 21 bp, Artificial Sequence
  siRNA
auguguacuuggguauggctt

SEQ ID NO: 2277 - DNA, 21 bp, Artificial Sequence
  siRNA
aaaugugcuauauguguactt

SEQ ID NO: 2278 - DNA, 21 bp, Artificial Sequence
  siRNA
guccaaagagggaaggucctt

SEQ ID NO: 2279 - DNA, 21 bp, Artificial Sequence
  siRNA
ucacacuuccuggcacaggtt

SEQ ID NO: 2280 - DNA, 21 bp, Artificial Sequence
  siRNA
uugcuguaacagcucacactt

SEQ ID NO: 2281 - DNA, 21 bp, Artificial Sequence
  siRNA
uuuuuucacuucuagcccctt

SEQ ID NO: 2282 - DNA, 21 bp, Artificial Sequence
  siRNA
ccagaauuacuuuuuucactt

SEQ ID NO: 2283 - DNA, 21 bp, Artificial Sequence
  siRNA
ugucuccagaauuacuuuutt

SEQ ID NO: 2284 - DNA, 21 bp, Artificial Sequence
  siRNA
cuugucuccagaauuacuutt

SEQ ID NO: 2285 - DNA, 21 bp, Artificial Sequence
  siRNA
ugcuugucuccagaauuactt

SEQ ID NO: 2286 - DNA, 21 bp, Artificial Sequence
  siRNA
auagugcuugucuccagaatt

SEQ ID NO: 2287 - DNA, 21 bp, Artificial Sequence
  siRNA
uaggaagagaaaauagugctt

SEQ ID NO: 2288 - DNA, 21 bp, Artificial Sequence
  siRNA
gccuugauggcaguaggcatt

SEQ ID NO: 2289 - DNA, 21 bp, Artificial Sequence
  siRNA
agaaaagcaaaacaaggcctt

SEQ ID NO: 2290 - DNA, 21 bp, Artificial Sequence
  siRNA
uuacacaugccacacacautt

SEQ ID NO: 2291 - DNA, 21 bp, Artificial Sequence
  siRNA
gauaguauauacacuuuuctt

SEQ ID NO: 2292 - DNA, 21 bp, Artificial Sequence
  siRNA
uaagauaguauauacacuutt

SEQ ID NO: 2293 - DNA, 21 bp, Artificial Sequence
  siRNA
uauaagauaguauauacactt

SEQ ID NO: 2294 - DNA, 21 bp, Artificial Sequence
  siRNA
agggagacgguugugcccctt

SEQ ID NO: 2295 - DNA, 21 bp, Artificial Sequence
  siRNA
gaacuauaaagggagacggtt

SEQ ID NO: 2296 - DNA, 21 bp, Artificial Sequence
  siRNA
aucuuaaacagacuauuuatt

SEQ ID NO: 2297 - DNA, 21 bp, Artificial Sequence
  siRNA
augaucuuaaacagacuautt

SEQ ID NO: 2298 - DNA, 21 bp, Artificial Sequence
  siRNA
uuuuuuuuuuuuuaugauctt

SEQ ID NO: 2299 - DNA, 21 bp, Artificial Sequence
  siRNA
uuuuuuuuuuuuuuuuuuutt

SEQ ID NO: 2300 - DNA, 21 bp, Artificial Sequence
  siRNA
cggcgcuggccccgccccutt

SEQ ID NO: 2301 - DNA, 21 bp, Artificial Sequence
  siRNA
cucgcagagcugggcuggutt

SEQ ID NO: 2302 - DNA, 21 bp, Artificial Sequence
  siRNA
aauugcagugcugaagacatt

SEQ ID NO: 2303 - DNA, 21 bp, Artificial Sequence
  siRNA
uugcagugcugaagacacutt

SEQ ID NO: 2304 - DNA, 21 bp, Artificial Sequence
  siRNA
gacacuggacccgcaaaagtt

SEQ ID NO: 2305 - DNA, 21 bp, Artificial Sequence
  siRNA
aaggcugucccucccaaactt

SEQ ID NO: 2306 - DNA, 21 bp, Artificial Sequence
  siRNA
ggcugucccucccaaaccutt

SEQ ID NO: 2307 - DNA, 21 bp, Artificial Sequence
  siRNA
accugggauucugggcucatt

SEQ ID NO: 2308 - DNA, 21 bp, Artificial Sequence
  siRNA
acaggcugcuggcauugagtt

SEQ ID NO: 2309 - DNA, 21 bp, Artificial Sequence
  siRNA
ugcugcugcugcacagagctt

SEQ ID NO: 2310 - DNA, 21 bp, Artificial Sequence
  siRNA
caggccugcagacucaagutt

SEQ ID NO: 2311 - DNA, 21 bp, Artificial Sequence
  siRNA
gucaauccccucaaggauctt

SEQ ID NO: 2312 - DNA, 21 bp, Artificial Sequence
  siRNA
uccccucaaggaucugcautt

SEQ ID NO: 2313 - DNA, 21 bp, Artificial Sequence
  siRNA
ggaucugcauucaggccugtt

SEQ ID NO: 2314 - DNA, 21 bp, Artificial Sequence
  siRNA
augauucauuucagccccatt

SEQ ID NO: 2315 - DNA, 21 bp, Artificial Sequence
  siRNA
cuccagcacccagggauggtt

SEQ ID NO: 2316 - DNA, 21 bp, Artificial Sequence
  siRNA
cacacauauacacuaaggatt

SEQ ID NO: 2317 - DNA, 21 bp, Artificial Sequence
  siRNA
ggaggaagugaguucccactt

SEQ ID NO: 2318 - DNA, 21 bp, Artificial Sequence
  siRNA
gugaguucccacaccagcctt

SEQ ID NO: 2319 - DNA, 21 bp, Artificial Sequence
  siRNA
uuuguggaccuacauccagtt

SEQ ID NO: 2320 - DNA, 21 bp, Artificial Sequence
  siRNA
agcugaugcuagcagcuggtt

SEQ ID NO: 2321 - DNA, 21 bp, Artificial Sequence
  siRNA
ccagucccaugugcgugagtt

SEQ ID NO: 2322 - DNA, 21 bp, Artificial Sequence
  siRNA
gauuggggagcugaauccutt

SEQ ID NO: 2323 - DNA, 21 bp, Artificial Sequence
  siRNA
uccugaagacaagguagcctt

SEQ ID NO: 2324 - DNA, 21 bp, Artificial Sequence
  siRNA
gacaagguagcccccaccgtt

SEQ ID NO: 2325 - DNA, 21 bp, Artificial Sequence
  siRNA
gguagcccccaccguggagtt

SEQ ID NO: 2326 - DNA, 21 bp, Artificial Sequence
  siRNA
ggucaacagccagcggccctt

SEQ ID NO: 2327 - DNA, 21 bp, Artificial Sequence
  siRNA
cagccagcggcccuuuaautt

SEQ ID NO: 2328 - DNA, 21 bp, Artificial Sequence
  siRNA
ugcagagccucccccugagtt

SEQ ID NO: 2329 - DNA, 21 bp, Artificial Sequence
  siRNA
aacuacaucacacccaacctt

SEQ ID NO: 2330 - DNA, 21 bp, Artificial Sequence
  siRNA
cuacaucacacccaacccutt

SEQ ID NO: 2331 - DNA, 21 bp, Artificial Sequence
  siRNA
cccuaucuucuucacccggtt

SEQ ID NO: 2332 - DNA, 21 bp, Artificial Sequence
  siRNA
ccaucugccuguaccuaactt

SEQ ID NO: 2333 - DNA, 21 bp, Artificial Sequence
  siRNA
ccuggauccagacaccuautt

SEQ ID NO: 2334 - DNA, 21 bp, Artificial Sequence
  siRNA
cuuucccagguacgagauctt

SEQ ID NO: 2335 - DNA, 21 bp, Artificial Sequence
  siRNA
ccgacgcucugagaugacutt

SEQ ID NO: 2336 - DNA, 21 bp, Artificial Sequence
  siRNA
agaaguaaaaggucuggagtt

SEQ ID NO: 2337 - DNA, 21 bp, Artificial Sequence
  siRNA
guaaaaggucuggaguggatt

SEQ ID NO: 2338 - DNA, 21 bp, Artificial Sequence
  siRNA
aaggucuggaguggagaactt

SEQ ID NO: 2339 - DNA, 21 bp, Artificial Sequence
  siRNA
ggucuggaguggagaacagtt

SEQ ID NO: 2340 - DNA, 21 bp, Artificial Sequence
  siRNA
caggagccaucagcacugctt

SEQ ID NO: 2341 - DNA, 21 bp, Artificial Sequence
  siRNA
cucugugaaacugaggccctt

SEQ ID NO: 2342 - DNA, 21 bp, Artificial Sequence
  siRNA
acugaggcccacgucugcutt

SEQ ID NO: 2343 - DNA, 21 bp, Artificial Sequence
  siRNA
gcugagguccugcuggcautt

SEQ ID NO: 2344 - DNA, 21 bp, Artificial Sequence
  siRNA
ugggcagccucugccacgutt

SEQ ID NO: 2345 - DNA, 21 bp, Artificial Sequence
  siRNA
auggcugggcagagugagutt

SEQ ID NO: 2346 - DNA, 21 bp, Artificial Sequence
  siRNA
aguuacagccacuggcaactt

SEQ ID NO: 2347 - DNA, 21 bp, Artificial Sequence
  siRNA
cggcgggauuacaaaggcutt

SEQ ID NO: 2348 - DNA, 21 bp, Artificial Sequence
  siRNA
aggcuucucuccaucugugtt

SEQ ID NO: 2349 - DNA, 21 bp, Artificial Sequence
  siRNA
cuuccuguccagucggccatt

SEQ ID NO: 2350 - DNA, 21 bp, Artificial Sequence
  siRNA
ucaggggaggugaccaucatt

SEQ ID NO: 2351 - DNA, 21 bp, Artificial Sequence
  siRNA
gggcuaugcauggaguggutt

SEQ ID NO: 2352 - DNA, 21 bp, Artificial Sequence
  siRNA
ccuggcagguggcuaagcutt

SEQ ID NO: 2353 - DNA, 21 bp, Artificial Sequence
  siRNA
gcuggauggagaggaacagtt

SEQ ID NO: 2354 - DNA, 21 bp, Artificial Sequence
  siRNA
cagcgccccaggaaggccutt

SEQ ID NO: 2355 - DNA, 21 bp, Artificial Sequence
  siRNA
ggccugggcauggcgucugtt

SEQ ID NO: 2356 - DNA, 21 bp, Artificial Sequence
  siRNA
agccccugugccagcuggatt

SEQ ID NO: 2357 - DNA, 21 bp, Artificial Sequence
  siRNA
aaggaacugaacauuguuutt

SEQ ID NO: 2358 - DNA, 21 bp, Artificial Sequence
  siRNA
ggaacugaacauuguuugutt

SEQ ID NO: 2359 - DNA, 21 bp, Artificial Sequence
  siRNA
cugaacauuguuuguaaggtt

SEQ ID NO: 2360 - DNA, 21 bp, Artificial Sequence
  siRNA
cauuguuuguaaggcugugtt

SEQ ID NO: 2361 - DNA, 21 bp, Artificial Sequence
  siRNA
ggcuguggaugaugguuactt

SEQ ID NO: 2362 - DNA, 21 bp, Artificial Sequence
  siRNA
ugugcagccagacaccgugtt

SEQ ID NO: 2363 - DNA, 21 bp, Artificial Sequence
  siRNA
ucuggaaccugcgaggugutt

SEQ ID NO: 2364 - DNA, 21 bp, Artificial Sequence
  siRNA
ccugcgagguguucucagctt

SEQ ID NO: 2365 - DNA, 21 bp, Artificial Sequence
  siRNA
ugccuggcaucguguccautt

SEQ ID NO: 2366 - DNA, 21 bp, Artificial Sequence
  siRNA
aggagccaccuccaccccutt

SEQ ID NO: 2367 - DNA, 21 bp, Artificial Sequence
  siRNA
aaaucuuucccaccuuucatt

SEQ ID NO: 2368 - DNA, 21 bp, Artificial Sequence
  siRNA
aucuuucccaccuuucaactt

SEQ ID NO: 2369 - DNA, 21 bp, Artificial Sequence
  siRNA
cuucuuggaucacaacucutt

SEQ ID NO: 2370 - DNA, 21 bp, Artificial Sequence
  siRNA
cucuggccuuccuaagccatt

SEQ ID NO: 2371 - DNA, 21 bp, Artificial Sequence
  siRNA
gccauacccaaguacacautt

SEQ ID NO: 2372 - DNA, 21 bp, Artificial Sequence
  siRNA
guacacauauagcacauuutt

SEQ ID NO: 2373 - DNA, 21 bp, Artificial Sequence
  siRNA
ggaccuucccucuuuggactt

SEQ ID NO: 2374 - DNA, 21 bp, Artificial Sequence
  siRNA
ccugugccaggaagugugatt

SEQ ID NO: 2375 - DNA, 21 bp, Artificial Sequence
  siRNA
gugugagcuguuacagcaatt

SEQ ID NO: 2376 - DNA, 21 bp, Artificial Sequence
  siRNA
ggggcuagaagugaaaaaatt

SEQ ID NO: 2377 - DNA, 21 bp, Artificial Sequence
  siRNA
gugaaaaaaguaauucuggtt

SEQ ID NO: 2378 - DNA, 21 bp, Artificial Sequence
  siRNA
aaaaguaauucuggagacatt

SEQ ID NO: 2379 - DNA, 21 bp, Artificial Sequence
  siRNA
aaguaauucuggagacaagtt

SEQ ID NO: 2380 - DNA, 21 bp, Artificial Sequence
  siRNA
guaauucuggagacaagcatt

SEQ ID NO: 2381 - DNA, 21 bp, Artificial Sequence
  siRNA
uucuggagacaagcacuautt

SEQ ID NO: 2382 - DNA, 21 bp, Artificial Sequence
  siRNA
gcacuauuuucucuuccuatt

SEQ ID NO: 2383 - DNA, 21 bp, Artificial Sequence
  siRNA
ugccuacugccaucaaggctt

SEQ ID NO: 2384 - DNA, 21 bp, Artificial Sequence
  siRNA
ggccuuguuuugcuuuucutt

SEQ ID NO: 2385 - DNA, 21 bp, Artificial Sequence
  siRNA
auguguguggcauguguaatt

SEQ ID NO: 2386 - DNA, 21 bp, Artificial Sequence
  siRNA
gaaaaguguauauacuauctt

SEQ ID NO: 2387 - DNA, 21 bp, Artificial Sequence
  siRNA
aaguguauauacuaucuuatt

SEQ ID NO: 2388 - DNA, 21 bp, Artificial Sequence
  siRNA
guguauauacuaucuuauatt

SEQ ID NO: 2389 - DNA, 21 bp, Artificial Sequence
  siRNA
ggggcacaaccgucucccutt

SEQ ID NO: 2390 - DNA, 21 bp, Artificial Sequence
  siRNA
ccgucucccuuuauaguuctt

SEQ ID NO: 2391 - DNA, 21 bp, Artificial Sequence
  siRNA
uaaauagucuguuuaagautt

SEQ ID NO: 2392 - DNA, 21 bp, Artificial Sequence
  siRNA
auagucuguuuaagaucautt

SEQ ID NO: 2393 - DNA, 21 bp, Artificial Sequence
  siRNA
gaucauaaaaaaaaaaaaatt

SEQ ID NO: 2394 - DNA, 21 bp, Artificial Sequence
  siRNA
aaaaaaaaaaaaaaaaaaatt

SEQ ID NO: 2395 - DNA, 21 bp, Artificial Sequence
  siRNA
aggggcggggccagcgccgtt

SEQ ID NO: 2396 - DNA, 21 bp, Artificial Sequence
  siRNA
accagcccagcucugcgagtt

SEQ ID NO: 2397 - DNA, 21 bp, Artificial Sequence
  siRNA
ugucuucagcacugcaauutt

SEQ ID NO: 2398 - DNA, 21 bp, Artificial Sequence
  siRNA
agugucuucagcacugcaatt

SEQ ID NO: 2399 - DNA, 21 bp, Artificial Sequence
  siRNA
gcagaccggguccaguguctt

SEQ ID NO: 2400 - DNA, 21 bp, Artificial Sequence
  siRNA
gcucugugcagcagcagcatt

SEQ ID NO: 2401 - DNA, 21 bp, Artificial Sequence
  siRNA
acuugagucugcaggccugtt

SEQ ID NO: 2402 - DNA, 21 bp, Artificial Sequence
  siRNA
gauccuugaggggauugactt

SEQ ID NO: 2403 - DNA, 21 bp, Artificial Sequence
  siRNA
augcagauccuugaggggatt

SEQ ID NO: 2404 - DNA, 21 bp, Artificial Sequence
  siRNA
caggccugaaugcagaucctt

SEQ ID NO: 2405 - DNA, 21 bp, Artificial Sequence
  siRNA
uggggcugaaaugaaucautt

SEQ ID NO: 2406 - DNA, 21 bp, Artificial Sequence
  siRNA
ccaucccugggugcuggagtt

SEQ ID NO: 2407 - DNA, 21 bp, Artificial Sequence
  siRNA
uccuuaguguauaugugugtt

SEQ ID NO: 2408 - DNA, 21 bp, Artificial Sequence
  siRNA
gugggaacucacuuccucctt

SEQ ID NO: 2409 - DNA, 21 bp, Artificial Sequence
  siRNA
ggcuggugugggaacucactt

SEQ ID NO: 2410 - DNA, 21 bp, Artificial Sequence
  siRNA
cuggauguagguccacaaatt

SEQ ID NO: 2411 - DNA, 21 bp, Artificial Sequence
  siRNA
ccagcugcuagcaucagcutt

SEQ ID NO: 2412 - DNA, 21 bp, Artificial Sequence
  siRNA
cucacgcacaugggacuggtt

SEQ ID NO: 2413 - DNA, 21 bp, Artificial Sequence
  siRNA
aggauucagcuccccaauctt

SEQ ID NO: 2414 - DNA, 21 bp, Artificial Sequence
  siRNA
ggcuaccuugucuucaggatt

SEQ ID NO: 2415 - DNA, 21 bp, Artificial Sequence
  siRNA
cggugggggcuaccuuguctt

SEQ ID NO: 2416 - DNA, 21 bp, Artificial Sequence
  siRNA
cuccacggugggggcuacctt

SEQ ID NO: 2417 - DNA, 21 bp, Artificial Sequence
  siRNA
gggccgcuggcuguugacctt

SEQ ID NO: 2418 - DNA, 21 bp, Artificial Sequence
  siRNA
auuaaagggccgcuggcugtt

SEQ ID NO: 2419 - DNA, 21 bp, Artificial Sequence
  siRNA
cucagggggaggcucugcatt

SEQ ID NO: 2420 - DNA, 21 bp, Artificial Sequence
  siRNA
gguugggugugauguaguutt

SEQ ID NO: 2421 - DNA, 21 bp, Artificial Sequence
  siRNA
aggguugggugugauguagtt

SEQ ID NO: 2422 - DNA, 21 bp, Artificial Sequence
  siRNA
ccgggugaagaagauagggtt

SEQ ID NO: 2423 - DNA, 21 bp, Artificial Sequence
  siRNA
guuagguacaggcagauggtt

SEQ ID NO: 2424 - DNA, 21 bp, Artificial Sequence
  siRNA
auaggugucuggauccaggtt

SEQ ID NO: 2425 - DNA, 21 bp, Artificial Sequence
  siRNA
gaucucguaccugggaaagtt

SEQ ID NO: 2426 - DNA, 21 bp, Artificial Sequence
  siRNA
agucaucucagagcgucggtt

SEQ ID NO: 2427 - DNA, 21 bp, Artificial Sequence
  siRNA
cuccagaccuuuuacuucutt

SEQ ID NO: 2428 - DNA, 21 bp, Artificial Sequence
  siRNA
uccacuccagaccuuuuactt

SEQ ID NO: 2429 - DNA, 21 bp, Artificial Sequence
  siRNA
guucuccacuccagaccuutt

SEQ ID NO: 2430 - DNA, 21 bp, Artificial Sequence
  siRNA
cuguucuccacuccagacctt

SEQ ID NO: 2431 - DNA, 21 bp, Artificial Sequence
  siRNA
gcagugcugauggcuccugtt

SEQ ID NO: 2432 - DNA, 21 bp, Artificial Sequence
  siRNA
gggccucaguuucacagagtt

SEQ ID NO: 2433 - DNA, 21 bp, Artificial Sequence
  siRNA
agcagacgugggccucagutt

SEQ ID NO: 2434 - DNA, 21 bp, Artificial Sequence
  siRNA
augccagcaggaccucagctt

SEQ ID NO: 2435 - DNA, 21 bp, Artificial Sequence
  siRNA
acguggcagaggcugcccatt

SEQ ID NO: 2436 - DNA, 21 bp, Artificial Sequence
  siRNA
acucacucugcccagccautt

SEQ ID NO: 2437 - DNA, 21 bp, Artificial Sequence
  siRNA
guugccaguggcuguaacutt

SEQ ID NO: 2438 - DNA, 21 bp, Artificial Sequence
  siRNA
agccuuuguaaucccgccgtt

SEQ ID NO: 2439 - DNA, 21 bp, Artificial Sequence
  siRNA
cacagauggagagaagccutt

SEQ ID NO: 2440 - DNA, 21 bp, Artificial Sequence
  siRNA
uggccgacuggacaggaagtt

SEQ ID NO: 2441 - DNA, 21 bp, Artificial Sequence
  siRNA
ugauggucaccuccccugatt

SEQ ID NO: 2442 - DNA, 21 bp, Artificial Sequence
  siRNA
accacuccaugcauagccctt

SEQ ID NO: 2443 - DNA, 21 bp, Artificial Sequence
  siRNA
agcuuagccaccugccaggtt

SEQ ID NO: 2444 - DNA, 21 bp, Artificial Sequence
  siRNA
cuguuccucuccauccagctt

SEQ ID NO: 2445 - DNA, 21 bp, Artificial Sequence
  siRNA
aggccuuccuggggcgcugtt

SEQ ID NO: 2446 - DNA, 21 bp, Artificial Sequence
  siRNA
cagacgccaugcccaggcctt

SEQ ID NO: 2447 - DNA, 21 bp, Artificial Sequence
  siRNA
uccagcuggcacaggggcutt

SEQ ID NO: 2448 - DNA, 21 bp, Artificial Sequence
  siRNA
aaacaauguucaguuccuutt

SEQ ID NO: 2449 - DNA, 21 bp, Artificial Sequence
  siRNA
acaaacaauguucaguucctt

SEQ ID NO: 2450 - DNA, 21 bp, Artificial Sequence
  siRNA
ccuuacaaacaauguucagtt

SEQ ID NO: 2451 - DNA, 21 bp, Artificial Sequence
  siRNA
cacagccuuacaaacaaugtt

SEQ ID NO: 2452 - DNA, 21 bp, Artificial Sequence
  siRNA
guaaccaucauccacagcctt

SEQ ID NO: 2453 - DNA, 21 bp, Artificial Sequence
  siRNA
cacggugucuggcugcacatt

SEQ ID NO: 2454 - DNA, 21 bp, Artificial Sequence
  siRNA
acaccucgcagguuccagatt

SEQ ID NO: 2455 - DNA, 21 bp, Artificial Sequence
  siRNA
gcugagaacaccucgcaggtt

SEQ ID NO: 2456 - DNA, 21 bp, Artificial Sequence
  siRNA
auggacacgaugccaggcatt

SEQ ID NO: 2457 - DNA, 21 bp, Artificial Sequence
  siRNA
agggguggagguggcuccutt

SEQ ID NO: 2458 - DNA, 21 bp, Artificial Sequence
  siRNA
ugaaaggugggaaagauuutt

SEQ ID NO: 2459 - DNA, 21 bp, Artificial Sequence
  siRNA
guugaaaggugggaaagautt

SEQ ID NO: 2460 - DNA, 21 bp, Artificial Sequence
  siRNA
agaguugugauccaagaagtt

SEQ ID NO: 2461 - DNA, 21 bp, Artificial Sequence
  siRNA
uggcuuaggaaggccagagtt

SEQ ID NO: 2462 - DNA, 21 bp, Artificial Sequence
  siRNA
auguguacuuggguauggctt

SEQ ID NO: 2463 - DNA, 21 bp, Artificial Sequence
  siRNA
aaaugugcuauauguguactt

SEQ ID NO: 2464 - DNA, 21 bp, Artificial Sequence
  siRNA
guccaaagagggaaggucctt

SEQ ID NO: 2465 - DNA, 21 bp, Artificial Sequence
  siRNA
ucacacuuccuggcacaggtt

SEQ ID NO: 2466 - DNA, 21 bp, Artificial Sequence
  siRNA
uugcuguaacagcucacactt

SEQ ID NO: 2467 - DNA, 21 bp, Artificial Sequence
  siRNA
uuuuuucacuucuagcccctt

SEQ ID NO: 2468 - DNA, 21 bp, Artificial Sequence
  siRNA
ccagaauuacuuuuuucactt

SEQ ID NO: 2469 - DNA, 21 bp, Artificial Sequence
  siRNA
ugucuccagaauuacuuuutt

SEQ ID NO: 2470 - DNA, 21 bp, Artificial Sequence
  siRNA
cuugucuccagaauuacuutt

SEQ ID NO: 2471 - DNA, 21 bp, Artificial Sequence
  siRNA
ugcuugucuccagaauuactt

SEQ ID NO: 2472 - DNA, 21 bp, Artificial Sequence
  siRNA
auagugcuugucuccagaatt

SEQ ID NO: 2473 - DNA, 21 bp, Artificial Sequence
  siRNA
uaggaagagaaaauagugctt

SEQ ID NO: 2474 - DNA, 21 bp, Artificial Sequence
  siRNA
gccuugauggcaguaggcatt

SEQ ID NO: 2475 - DNA, 21 bp, Artificial Sequence
  siRNA
agaaaagcaaaacaaggcctt

SEQ ID NO: 2476 - DNA, 21 bp, Artificial Sequence
  siRNA
uuacacaugccacacacautt

SEQ ID NO: 2477 - DNA, 21 bp, Artificial Sequence
  siRNA
gauaguauauacacuuuuctt

SEQ ID NO: 2478 - DNA, 21 bp, Artificial Sequence
  siRNA
uaagauaguauauacacuutt

SEQ ID NO: 2479 - DNA, 21 bp, Artificial Sequence
  siRNA
uauaagauaguauauacactt

SEQ ID NO: 2480 - DNA, 21 bp, Artificial Sequence
  siRNA
agggagacgguugugcccctt

SEQ ID NO: 2481 - DNA, 21 bp, Artificial Sequence
  siRNA
gaacuauaaagggagacggtt

SEQ ID NO: 2482 - DNA, 21 bp, Artificial Sequence
  siRNA
aucuuaaacagacuauuuatt

SEQ ID NO: 2483 - DNA, 21 bp, Artificial Sequence
  siRNA
augaucuuaaacagacuautt

SEQ ID NO: 2484 - DNA, 21 bp, Artificial Sequence
  siRNA
uuuuuuuuuuuuuaugauctt

SEQ ID NO: 2485 - DNA, 21 bp, Artificial Sequence
  siRNA
uuuuuuuuuuuuuuuuuuutt

SEQ ID NO: 2486 - DNA, 21 bp, Artificial Sequence
  siRNA
cggcgcuggccccgccccutt

SEQ ID NO: 2487 - DNA, 21 bp, Artificial Sequence
  siRNA
cucgcagagcugggcuggutt

SEQ ID NO: 2488 - DNA, 21 bp, Artificial Sequence
  siRNA
aauugcagugcugaagacatt

SEQ ID NO: 2489 - DNA, 21 bp, Artificial Sequence
  siRNA
uugcagugcugaagacacutt

SEQ ID NO: 2490 - DNA, 21 bp, Artificial Sequence
  siRNA
gacacuggacccggucugctt

SEQ ID NO: 2491 - DNA, 21 bp, Artificial Sequence
  siRNA
ugcugcugcugcacagagctt

SEQ ID NO: 2492 - DNA, 21 bp, Artificial Sequence
  siRNA
caggccugcagacucaagutt

SEQ ID NO: 2493 - DNA, 21 bp, Artificial Sequence
  siRNA
gucaauccccucaaggauctt

SEQ ID NO: 2494 - DNA, 21 bp, Artificial Sequence
  siRNA
uccccucaaggaucugcautt

SEQ ID NO: 2495 - DNA, 21 bp, Artificial Sequence
  siRNA
ggaucugcauucaggccugtt

SEQ ID NO: 2496 - DNA, 21 bp, Artificial Sequence
  siRNA
augauucauuucagccccatt

SEQ ID NO: 2497 - DNA, 21 bp, Artificial Sequence
  siRNA
cuccagcacccagggauggtt

SEQ ID NO: 2498 - DNA, 21 bp, Artificial Sequence
  siRNA
cacacauauacacuaaggatt

SEQ ID NO: 2499 - DNA, 21 bp, Artificial Sequence
  siRNA
ggaggaagugaguucccactt

SEQ ID NO: 2500 - DNA, 21 bp, Artificial Sequence
  siRNA
gugaguucccacaccagcctt

SEQ ID NO: 2501 - DNA, 21 bp, Artificial Sequence
  siRNA
uuuguggaccuacauccagtt

SEQ ID NO: 2502 - DNA, 21 bp, Artificial Sequence
  siRNA
agcugaugcuagcagcuggtt

SEQ ID NO: 2503 - DNA, 21 bp, Artificial Sequence
  siRNA
ccagucccaugugcgugagtt

SEQ ID NO: 2504 - DNA, 21 bp, Artificial Sequence
  siRNA
gauuggggagcugaauccutt

SEQ ID NO: 2505 - DNA, 21 bp, Artificial Sequence
  siRNA
uccugaagacaagguagcctt

SEQ ID NO: 2506 - DNA, 21 bp, Artificial Sequence
  siRNA
gacaagguagcccccaccgtt

SEQ ID NO: 2507 - DNA, 21 bp, Artificial Sequence
  siRNA
gguagcccccaccguggagtt

SEQ ID NO: 2508 - DNA, 21 bp, Artificial Sequence
  siRNA
ggucaacagccagcggccctt

SEQ ID NO: 2509 - DNA, 21 bp, Artificial Sequence
  siRNA
cagccagcggcccuuuaautt

SEQ ID NO: 2510 - DNA, 21 bp, Artificial Sequence
  siRNA
ugcagagccucccccugagtt

SEQ ID NO: 2511 - DNA, 21 bp, Artificial Sequence
  siRNA
aacuacaucacacccaacctt

SEQ ID NO: 2512 - DNA, 21 bp, Artificial Sequence
  siRNA
cuacaucacacccaacccutt

SEQ ID NO: 2513 - DNA, 21 bp, Artificial Sequence
  siRNA
cccuaucuucuucacccggtt

SEQ ID NO: 2514 - DNA, 21 bp, Artificial Sequence
  siRNA
ccaucugccuguaccuaactt

SEQ ID NO: 2515 - DNA, 21 bp, Artificial Sequence
  siRNA
ccuggauccagacaccuautt

SEQ ID NO: 2516 - DNA, 21 bp, Artificial Sequence
  siRNA
cuuucccagguacgagauctt

SEQ ID NO: 2517 - DNA, 21 bp, Artificial Sequence
  siRNA
ccgacgcucugagaugacutt

SEQ ID NO: 2518 - DNA, 21 bp, Artificial Sequence
  siRNA
agaaguaaaaggucuggagtt

SEQ ID NO: 2519 - DNA, 21 bp, Artificial Sequence
  siRNA
guaaaaggucuggaguggatt

SEQ ID NO: 2520 - DNA, 21 bp, Artificial Sequence
  siRNA
aaggucuggaguggagaactt

SEQ ID NO: 2521 - DNA, 21 bp, Artificial Sequence
  siRNA
ggucuggaguggagaacagtt

SEQ ID NO: 2522 - DNA, 21 bp, Artificial Sequence
  siRNA
caggagccaucagcacugctt

SEQ ID NO: 2523 - DNA, 21 bp, Artificial Sequence
  siRNA
cucugugaaacugaggccctt

SEQ ID NO: 2524 - DNA, 21 bp, Artificial Sequence
  siRNA
acugaggcccacgucugcutt

SEQ ID NO: 2525 - DNA, 21 bp, Artificial Sequence
  siRNA
gcugagguccugcuggcautt

SEQ ID NO: 2526 - DNA, 21 bp, Artificial Sequence
  siRNA
ugggcagccucugccacgutt

SEQ ID NO: 2527 - DNA, 21 bp, Artificial Sequence
  siRNA
auggcugggcagagugagutt

SEQ ID NO: 2528 - DNA, 21 bp, Artificial Sequence
  siRNA
aguuacagccacuggcaactt

SEQ ID NO: 2529 - DNA, 21 bp, Artificial Sequence
  siRNA
cggcgggauuacaaaggcutt

SEQ ID NO: 2530 - DNA, 21 bp, Artificial Sequence
  siRNA
aggcuucucuccaucugugtt

SEQ ID NO: 2531 - DNA, 21 bp, Artificial Sequence
  siRNA
cuuccuguccagucggccatt

SEQ ID NO: 2532 - DNA, 21 bp, Artificial Sequence
  siRNA
ucaggggaggugaccaucatt

SEQ ID NO: 2533 - DNA, 21 bp, Artificial Sequence
  siRNA
gggcuaugcauggaguggutt

SEQ ID NO: 2534 - DNA, 21 bp, Artificial Sequence
  siRNA
ccuggcagguggcuaagcutt

SEQ ID NO: 2535 - DNA, 21 bp, Artificial Sequence
  siRNA
gcuggauggagaggaacagtt

SEQ ID NO: 2536 - DNA, 21 bp, Artificial Sequence
  siRNA
cagcgccccaggaaggccutt

SEQ ID NO: 2537 - DNA, 21 bp, Artificial Sequence
  siRNA
ggccugggcauggcgucugtt

SEQ ID NO: 2538 - DNA, 21 bp, Artificial Sequence
  siRNA
agccccugugccagcuggatt

SEQ ID NO: 2539 - DNA, 21 bp, Artificial Sequence
  siRNA
aaggaacugaacauuguuutt

SEQ ID NO: 2540 - DNA, 21 bp, Artificial Sequence
  siRNA
ggaacugaacauuguuugutt

SEQ ID NO: 2541 - DNA, 21 bp, Artificial Sequence
  siRNA
cugaacauuguuuguaaggtt

SEQ ID NO: 2542 - DNA, 21 bp, Artificial Sequence
  siRNA
cauuguuuguaaggcugugtt

SEQ ID NO: 2543 - DNA, 21 bp, Artificial Sequence
  siRNA
ggcuguggaugaugguuactt

SEQ ID NO: 2544 - DNA, 21 bp, Artificial Sequence
  siRNA
ugugcagccagacaccgugtt

SEQ ID NO: 2545 - DNA, 21 bp, Artificial Sequence
  siRNA
ucuggaaccugcgaggugutt

SEQ ID NO: 2546 - DNA, 21 bp, Artificial Sequence
  siRNA
ccugcgagguguucucagctt

SEQ ID NO: 2547 - DNA, 21 bp, Artificial Sequence
  siRNA
ugccuggcaucguguccautt

SEQ ID NO: 2548 - DNA, 21 bp, Artificial Sequence
  siRNA
aggagccaccuccaccccutt

SEQ ID NO: 2549 - DNA, 21 bp, Artificial Sequence
  siRNA
aaaucuuucccaccuuucatt

SEQ ID NO: 2550 - DNA, 21 bp, Artificial Sequence
  siRNA
aucuuucccaccuuucaactt

SEQ ID NO: 2551 - DNA, 21 bp, Artificial Sequence
  siRNA
cuucuuggaucacaacucutt

SEQ ID NO: 2552 - DNA, 21 bp, Artificial Sequence
  siRNA
cucuggccuuccuaagccatt

SEQ ID NO: 2553 - DNA, 21 bp, Artificial Sequence
  siRNA
gccauacccaaguacacautt

SEQ ID NO: 2554 - DNA, 21 bp, Artificial Sequence
  siRNA
guacacauauagcacauuutt

SEQ ID NO: 2555 - DNA, 21 bp, Artificial Sequence
  siRNA
ggaccuucccucuuuggactt

SEQ ID NO: 2556 - DNA, 21 bp, Artificial Sequence
  siRNA
ccugugccaggaagugugatt

SEQ ID NO: 2557 - DNA, 21 bp, Artificial Sequence
  siRNA
gugugagcuguuacagcaatt

SEQ ID NO: 2558 - DNA, 21 bp, Artificial Sequence
  siRNA
ggggcuagaagugaaaaaatt

SEQ ID NO: 2559 - DNA, 21 bp, Artificial Sequence
  siRNA
gugaaaaaaguaauucuggtt

SEQ ID NO: 2560 - DNA, 21 bp, Artificial Sequence
  siRNA
aaaaguaauucuggagacatt

SEQ ID NO: 2561 - DNA, 21 bp, Artificial Sequence
  siRNA
aaguaauucuggagacaagtt

SEQ ID NO: 2562 - DNA, 21 bp, Artificial Sequence
  siRNA
guaauucuggagacaagcatt

SEQ ID NO: 2563 - DNA, 21 bp, Artificial Sequence
  siRNA
uucuggagacaagcacuautt

SEQ ID NO: 2564 - DNA, 21 bp, Artificial Sequence
  siRNA
gcacuauuuucucuuccuatt

SEQ ID NO: 2565 - DNA, 21 bp, Artificial Sequence
  siRNA
ugccuacugccaucaaggctt

SEQ ID NO: 2566 - DNA, 21 bp, Artificial Sequence
  siRNA
ggccuuguuuugcuuuucutt

SEQ ID NO: 2567 - DNA, 21 bp, Artificial Sequence
  siRNA
auguguguggcauguguaatt

SEQ ID NO: 2568 - DNA, 21 bp, Artificial Sequence
  siRNA
gaaaaguguauauacuauctt

SEQ ID NO: 2569 - DNA, 21 bp, Artificial Sequence
  siRNA
aaguguauauacuaucuuatt

SEQ ID NO: 2570 - DNA, 21 bp, Artificial Sequence
  siRNA
guguauauacuaucuuauatt

SEQ ID NO: 2571 - DNA, 21 bp, Artificial Sequence
  siRNA
ggggcacaaccgucucccutt

SEQ ID NO: 2572 - DNA, 21 bp, Artificial Sequence
  siRNA
ccgucucccuuuauaguuctt

SEQ ID NO: 2573 - DNA, 21 bp, Artificial Sequence
  siRNA
uaaauagucuguuuaagautt

SEQ ID NO: 2574 - DNA, 21 bp, Artificial Sequence
  siRNA
auagucuguuuaagaucautt

SEQ ID NO: 2575 - DNA, 21 bp, Artificial Sequence
  siRNA
gaucauaaaaaaaaaaaaatt

SEQ ID NO: 2576 - DNA, 21 bp, Artificial Sequence
  siRNA
aaaaaaaaaaaaaaaaaaatt

What is claimed is:

1. A method for identifying a combination of siRNA molecules selected from the group disclosed Tables 5-10 effective for down-regulating the expression of at least one protein selected from the group consisting of RAB5B, CDK2, SUOX, IKZF4, RPS26 and ERBB3, comprising:
   a) contacting a cell with an effective amount of at least two siRNA molecules selected from the group disclosed in Tables 5-10;
   b) assessing the effect of said siRNAs on down regulation of at least RPS26 expression relative to untreated cells.

2. The method of claim 1, wherein said cells are selected from the group consisting of INS cells, PC12 cells, MING cells, pancreatic beta islet cells and alpha TC6 cells.

3. The method of claim 2 wherein modulatory effects of said siRNAs on a parameter selected from the group consisting of insulin secretion, glucagon secretion and glucosamine induced beta cell apoptosis is determined.

* * * * *

UNITED STATES PATENT AND TRADEMARK OFFICE
CERTIFICATE OF CORRECTION

PATENT NO.       : 8,575,120 B2  
APPLICATION NO.  : 12/531257  
DATED            : November 5, 2013  
INVENTOR(S)      : Hakonarson et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 742 days.

Signed and Sealed this

Twenty-second Day of September, 2015

Michelle K. Lee  
*Director of the United States Patent and Trademark Office*